United States Patent 12,642,819 (COMPOSITIONS AND METHODS FOR TREATING INFLAMMATORY BOWEL DISEASE) - sequence listing, part 85

SEQ ID NO: 43 - DNA, 5216793 bp, Escherichia coli (residues 1-1,738,931 of 5,216,793)
  modified_base (352572)..(352669): a, c, t, g, unknown or other
  modified_base (523661)..(523758): a, c, t, g, unknown or other
  modified_base (1285784)..(1285875): a, c, t, g, unknown or other
  modified_base (1782118)..(1782213): a, c, t, g, unknown or other
  modified_base (1799406)..(1799503): a, c, t, g, unknown or other
  modified_base (2297170)..(2297266): a, c, t, g, unknown or other
  modified_base (4252625)..(4252722): a, c, t, g, unknown or other
  modified_base (5099493)..(5099801): a, c, t, g, unknown or other
aatccgtatcttcgagtgcccacacagattgtctgataaattgttaaagagcagttgtgacgcggctttcagctcactgtcgcgaggtggcgtatattacgctttcctctttcagagtcaaccctgaatttcaggatttttctcttcaaccgaaccgactgtttgtgtgaagtgattcacatccgccgtgtcgatggaggcgcattatagggagtcggctcaggaagacaagcggaaaaatgcatttttatttcaaccgctcatcttttaatcattacgccggtttttgctgcttttttatcgcttgcggcaggtctgccaggctatttaacacccaatccgccgcgttttctgcttcaggcgtaacaggtttacccgtacgcaccagcacttttgttcccacgttcgccgcagcagctgcctgcatatcttctaatttatcgcccaccatataagaagcagccatatcaatatgcaaataatcgcgtgccgacaaaagcatccccggatgtggtttgcggcagtcgcagacctggcgaaactcttcaacactaccctgcggatgatgcgggcaataatagataccatccagatcgacatcgcggtccgccagcgaccagtccatccactcggtcagcgtttcaaactgtgcttcagtaaatttaccgcgagcaatgccagactggttggtgactaccaccagcgcgaagcccattttttttagctcgcgcatggcgtcaataacaccgtcgataaattcaaagttatcgatctcatggacatagccgtgatcgacattaatggtgccatcacggtcaagaaaaattgcgggtacgctcttcgccaccttttatagctccttaataaggcatgtgacgctagtatcgcatgtttcgacctgcaagaaagtgctcttcgcataaacctgattgatttagacgtctggatgccttaacatccatttcattgacggcgttgcccgtttcaggcattcgaaatgccacgactaacttaatgacgataataaataatcaatgataaaactttcgaatatcaccaaagtgttccaccagggcacccgcaccatccaggcgttgaacaacgtcagcctgcatgtgccagctgggcaaatttatggcgttatcggtgcctcaggcgcgggtaagagtacgcttatacgttgtgtaaacctgctggagcgcccaaccgagggtagcgtgctggtcgatggacaggaactgaccacgctgtcagaatccgagttgaccaaagctcgccgccagattggtatgattttccagcattttaacctgctctcttcgcgtactgtttttggcaacgtggctctgccgctggagctggacaatacaccgaaagacgagatcaaacgtcgcgtgacggaattgctgtcattggttggtcttggcgataagcatgatagctacccgtcgaatctttccggtgggcagaaacaacgtgtggcgattgcccgtgcattagccagcaatcccaaagtattgctgtgtgatgaagccaccagcgcgctggacccggcaacgacacgttctattctcgaactgctgaaagacattaaccgccgtctgggtttgacgattctgttgatcacccacgaaatggacgttgtgaagcgcatttgtgattgcgtggcggtcatcagtaatggcgaactgatcgagcaggacacggtaagtgaagtgttctcgcatccgaaaacgccgctggcgcagaagtttattcagtcgaccctgcatctggatatcccggaagattatcaggagcgtctgcaagcggagccattcactgactgcgtgccgatgctgcgtctggagtttaccggtcaatcggtcgatgccccactgctttctgaaaccgcgcgtcgtttcaacgtcaacaacaacattattagcgcgcagatggattacgccggtggcgttaagttcggcatcatgctgactgaaatgcacggcacacaacaagatacgcaagccgccattgcctggctgcaggaacaccatgtaaaagtagaggtactgggttatgtctgagccgatgatgtggctgctggttcgtggcgtatgggaaacgctggcaatgaccttcgtatccggattttttgggtttgtgattggtctgccggtcggcgtcctgctttatgttacgcgcccggggcaaattattgctaacgcgaagctgtatcgtaccgtttctgcgattgtgaacattttccgttctatcccgttcattatcttgctggtatggatgattccgtttacccgcgttattgtcggtacatcgattggtttgcaggcagcgattgttccgttaaccgttggtgcagcaccgtttattgcccgtatggtcgagaacgctctgctggagatcccaaccgggctaattgaagcttcccgcgcaatgggtgccacgccgatgcagatcgtccgtaaagtgctgttaccggaagcattgccgggtctggtgaatgctgcgactatcaccctgattaccctggtcggttattccgcgatgggtggtgcagtcggtgccggtggtttaggtcagattggctatcagtatggctacatcggctacaacgcgacggtgatgaatacggtactggtattgctggtcattctggtttatttaattcagttcgcaggcgaccgcatcgtccgggctgtcactcgcaagtaacgttcaacacaacataaataattgaagaaggaataaggtatggcgttcaaattcaaaacctttgcggcagtgggagccctgattggatcactggcactggtaggctgcggtcaggatgaaaaagatccaaaccacattaaagtcggcgtgattgttggtgccgaacagcaggttgcagaagtcgcgcagaaagttgcgaaagacaaatatggcctggacgttgagctggtaaccttcaacgactatgttctgccaaacgaagcattgagcaaaggcgatatcgacgccaacgccttccagcataaaccgtaccttgatcagcaactgaaagatcgtggctacaaactggtcgcagtaggcaacacttttgtttatccgattgcaggttactccaagaaaatcaaatcactggatgaactgcaggatggttcgcaggttgccgtgccaaacgacccaactaaccttggtcgttcactgctgctgctgcaaaaagtgggcttgatcaaactgaaagatggcgttggcctgctgccgaccgttcttgatgttgttgagaacccaaaaaatctgaaaattgttgagctggaagcaccgcagctgcctcgctctctggacgacgcgcaaatcgctctggcagttatcaataccacctatgccagccagattggcctgactccggcgaaagacggtatctttgtcgaagataaagactccccgtacgtaaacctgatcgtgacgcgtgaagataacaaagacgccgagaacgtgaagaaattcgtccaggcttatcagtctgacgaagtttacgaagcagcaaacaaagtgtttaacggcggcgctgttaaaggctggtaatttttaggctgtttccacaatttgtaatatcattcaggacgggcgcttgcccgtcttgtcatttttacaagctcctgattcaatattgacgttttgatcatacattgaggaaatactatgcgtgctttaccgatctgtttagtagcactcatgctaagcggctgttccatgttaagcagatcccctgtcgaacccgttcaaagcactgcaccccagccgaaagcggagcctgcaaaaccgaaagcgccgcgcgccacgccggtccgaatttataccaatgcagaagaattagtcggcaaaccgttccgcgatctcggtgaagtcagtggcgactcttgccaggcctctaatcaggactctccgccgagcattccaaccgcacgtaagcggatgcaaatcaacgcctctaaaatgaaagccaatgcggtattactgcatagctgcgaagtcaccagcggtacgccaggttgctatcgtcaggctgtatgtatcggttctgcgcttaacatcacggcgaaatgagcagtttccaattcgagcaaataggcgttattcgctcgccctataaagaaaaattcgccgttccgcgccagccaggtctggtaaaaagcgccaacggcgaactgcatctcattgctccctacaaccaggccgacgccgttcgcggcctggaagcgttcagccatttatggatccttttcgtctttcatcaaacgatggaaggcggctggcgtccgactgtgcgtccaccgcgcctcggcggtaataccagaatgggtgttttcgctacgcgctccactttccgccctaacccgattggtatgtcgctggtagagctgaaagaggttgtttgccataaagacagcgtgattctgaagctcggcagtctggatctggtagatgggacgccggtggtggatatcaaaccgtatctcccctttgccgaatcgcttcccgatgccagtgccagctatgcgcaaagtgcgccagctgcagagatggcggtgagttttaccgcagaggtcgaaaagcagcttttgacgctggagaagcgttatccgcagttaacgctgtttatccgcgaagtactggcgcaggacccgcgcccggcctatcgtaaaggtgaggaaacgggcaaaacctatgccgtctggctgcatgattttaacgttcgctggcgcgtcaccgacgcaggttttgaagtctttgcgctggaaccgcgttaaattcacgcccttctcttttgacatttcttttgcactggtaaactaaatcactttttttgtcccaggctcaccttgagcctgttctaccttccaactggaaccgtaacaacatgcgtactagccaatacctgctctccactctcaaggagacacctgccgacgccgaggtgatcagccatcagctgatgctgcgcgccgggatgatccgcaagctggcctccgggttatatacctggctgccgaccggcgtgcgcgttctgaaaaaagtcgaaaacatcgtgcgtgaagagatgaacaacgccggtgcgatcgaggtgtcgatgccggtggttcagccagccgatttgtggcaagagagtggtcgttgggaacagtacggtccggaactgctgcgttttgttgaccgtggcgagcgtccgttcgtactcggcccaactcatgaagaagttattacagacctgattcgtaacgagcttagctcttacaaacagctgccgctgaacttctatcagatccagaccaagttccgcgacgaagtgcgtccgcgtttcggcgtcatgcgttcccgcgaattcctgatgaaagatgcttactctttccatacttctcaggaatccctgcaggaaacctacgatgcaatgtatgcggcctacagcaaaatcttcagccgcatggggctggatttccgcgccgtacaggccgacaccggttctatcggcggtagcgcctctcacgaattccaggtgctggcgcagagcggtgaagacgatgtggtcttctccgacacctctgactatgcagcgaacattgagctggcagaagctatcgcgccgaaagaaccgcgcgctgctgctacccaggaaatgacgctggttgatacgccgaacgcgaaaaccatcgcggaactggttgaacagttcaatctgccgattgagaaaacggtgaagactctgctggttaaagcggttgaaggcagtagcttcccgctggttgcgctgctggtgcgtggtgaccacgagctgaacgaagttaaagcagaaaaactgccgcaggttgcaagcccgctgacttttgcgaccgaagaagaaattcgtgccgtggttaaagccggtccgggttcactgggtccggtaaacatgccgattccggtggtgattgaccgtaccgttgcagcgatgagtgatttcgctgctggtgctaacatcgatggtaaacactacttcggcatcaactgggatcgcgatgtcgctaccccagaaattgctgatatccgtaacgtggtggcgggcgatccaagcccggatggccagggtacactgctgatcaaacgtggtatcgaagttggtcacatcttccagctgggtaccaagtactccgaagcactgaaagcctccgtacagggtgaagatggccgtaatcaaatcctgacgatgggttgctacggtatcggagtaacgcgtgtagtagctgcggcgattgagcagaactacgacgaacgcggcatcgtatggccggacgctatcgcaccgttccaggtggcgattctgccgatgaacatgcacaaatccttccgcgtacaggagcttgctgagaaactgtacagcgaactgcgcgcgcagggtatcgaagtgctgctggatgaccgcaaagagcgtccgggcgtgatgtttgctgatatggaactgatcggtattccgcacactattgtgctgggcgaccgtaacctcgacaacgacgatatcgaatataaatatcgtcgtaacggcgagaaacagttaattaagactggtgacatcgtcgattatctggtgaaacagattaaaggctgatgccagaaagggtcctgaatttcagggcccttttttacatggcttgtataaaatggataaaccaaaggcgcattgctgcctgcttctcccctgctttcttttcctttcggcctgtaccgtagatatcagccagccagactcatcagccacagcggtagatgccggggcgaaaacatgggcagtccaattccagcatcaaagctcttttaccgaacaatcaataaaagaaataacggaacctgatctcaaacccggcgatttgctgttctcctcaagccttggggtaacctcatttggaatccgcgtcttcagcacttcctctgtgagtcacgttgcaatctatctgggtgaaaataacgttgcagaagcgacaggcgctggcgtccagattgtttccctcaaaaaagcgatgaagcatagcgataagcttttcgtcttacgagtcccggatcttaccccgcaacaagccacagaaatcaccgcgttcgccaacaaaattaaagatagcggttacaactatcgcggcattgtcgaatttattccctttatggtgactcgccagatgtgctcactgaatccgttctccgaggattttcgtcaacagtgcgtcagcggcctggcgaaagcgcagttaagcagtgtgggcgaaggagacaaaaagtcgtggttttgttcggaatttgtcactgatgcatttgccaaagccgggcatccgcttaccctggcgcaatcgggctggattagccctgccgatctgatgcatatgcgtattggtgatgtctctgcgtttaagccagaaacgcagttacagtatgttgggcacctgaagccagggatttatatcaaggcgggtcgctttgttgggctgactcagtgatgaaagccggagaatgctccggctttcaattactgccccaaactactgcaatcctggttcgggtaaaatttacctgccgtatcgggcgctaatactttggttggcgcaccggtatccggattagcctcaagcgtaaagtgaccttctactgacagtaacatcggtttttcactatgaccgcgcgccgccaggtagccacgctccagctctgcattattcgctaccatgaaacgttttccggtcgcgcaatcagtgaaggtcgccgcatcagccatataaaaatacatgccccgcagggtcatcggcgtcatgggtaaactggattgcgccggttccagcgtatagtagaactgcgattcaatcggattaccttcacgatcgagcatctccagcgcatcgcctttcgcccgataatatgacttttcacctttgctgtcggttaataccagcttgtcagcggttcgcgcccatgtaccgtaggaagcgaaagaggaaggctcttcacgcgcaccaagatagcgttcattcatcacccaggttccatctttttcgaggaacagagaggtttcgatcccttcgcaatcggcacacggcagcacgccgcgccaactttgcggcatcggtttcagttcggcagcctgcgccggagaaagcgtgtcgacttcggcccgattattacatcccatcagagtaaagaggctgattacagccatcgctgtcactatcgcttttttcaccatccattccttctttttattcccgaccgctgcgcactttgccgcgcatcgccttcacgcttgatttttgtgctttcgatgccagcctgcgctcttttgatgcgcgggtgggccgcgtgggtcgtcgggctttttgttctgttgttaaatctttaatcactgccaccagccgggccagcgccgcttcgcggttgagctcctgattgcggtattcctgtgccttaatgacaatcacgccatcactgctgatcaaatgatggctggcggcgagcagacgctctttgtaatactctggcaggctggacgcccgaatgtcaaaacgcagatgaatagccgttgaggtcttattaacatgctgcccgcccgcgccctgcgcacgaatggcggtgatctcaagctcaccatcggggatagcaacatgtcgggaaatcacaatcatgaaggttgttgccagacggttaagttcacttccagattattcttatcatccgataaccagatcacgccatcctgaatcgttgcctgcagcgtcatggtacgatcggcaaaggcgcttactttcgccagttgttcatcgtccagataccagacggaaagattggcaaactgcgcacatttgctctgattttgctgccaccagatttgcgccgcccgactattataggcaaacagcgctacttctgcggcctgggtgcaggctttcttaatccgccgctcatccggcagccccagctcaatccacaaatcaatgcccaaatgatcgttacgccgccacgcttccggctcatcatcggcacacaagccacgggtaaattgcagacgttcatcggcatattttagccacgccagcaggcgcagcatcatacgctcctgggtttctgaaggatggcgcgccagcgtcagagaggcatcgagaaactggttgcggtcgagatcggccacattaaccgtcgctttataaattgtcgctttaagcgccataagaaaactcctttcgaatcaggaggccattgtaacggaatacgtgcagttgcggcgctgatattgcagaaatgagtgtggtatagtcaccttgcgaaacagagtttatcttcgtaggcttagacttgcatccacggttaagtcagagtgctgacaggagggcatgtggaaaaatattgtgagttaatacgcaagcggtacgcggaaatcgccagcggagacttaggatacgttccggacgcgctgggctgcgttttgaaagtgctgaatgaaatggctgccgacgacgccctttctgaggctgtcagggaaaaagcagcatacgctgcggcaaacttactggtgagcgattatgtcaatgaatgatacgtatcaaccaatcaattgtgatgattacgataatcttgagctcgcctgccagcatcatttaatgctgacacttgagctgaaagatggcgaaaaattgcaggcgaaggccagcgatttagtctcccgcaaaaatgtggagtatctggtcgtcgaggccgctggtacaacccgcgagctgcgtctggataaaattaccagctttagccacccggaaatcggtacggtggtggtgagcgagtcctgattgacttttgccggatgcgacgtttgatgcgtatccggccttcactgactaaccatttctctgccagacaaaacttactccattctcactttcagccataccttcttgcgtcataaatactcctgccgccgcaatcagcgtttcgccataaaacagcagtggcgtggtgtcacgtagccacggcggaacgcccagctcctgccagattttcttcagcttacgtccgccgttgcgcccgataatatgcagcaatcctggcgctttgaaacgtacgctgaccgcttcgtctgcacgcggagggcgaatatcgcctcccgcagtaagctgtacacttcccagtcccgccggtaattccagcggttgtagccacgtctgccacggcacaatggtttcgctttgcccagtgacggatttaatccaccacagttgcgactgatagcggcggatttcaaacgcgcccaggcgtaaacagggggaagcatcttcccgcgccagcgccacttcctgccagatcctcaccaacgcgtcgcgggaaggcatcggtgcattcttccctgccagccagcggcggataatcgccgcgcggcgggcatcactcatcgccagcattggcgcaatctgcagcgtcccctgcgacgtttgacagtgcgctatatcatccgccagcagttcatctaacaggctctcttgttcagcgcaaagcgcagcgctgcgggccgttgcttcggcaaaatgcggccaacgctgctgcaataacggcaccacgcgcaggcgcaggaagttacgatcgtagctatcatcctgattactttcgtcttcaatccagcgtaaaccatgcgccaatgcccactgctccagttccccccgcgtgcgggcgagcaacgggcggataagccgtgttccggcaaactccgaaacttcccccatagccgaaagcccggcagggccgctaccgcgttttagcgccagcagaaaggtttcacattgatcgtcgagatgttgcgcggtgaccagcacttcaccgggcaacaaggtgcgggcaaatgcctgataacgtgcctgccgcgcctgggcctcaatacctagcccctcttgcgcaagttgcacgcgctcgaccaccagcggcacctgccattgttggcagatgttctcgcaatgcctaacccaggcgtcggcattggcacttaaaccgtgatgcacatgaatagcgcgcagagtgacgcccggattttccgcccgccactgcaccaactgatgcagcaaaacggtggagtcaagcccgccgctaaaggccaccagaatctggcgtgaggtgagaagttgtctattgagcgtgagtgtcatgatggtgcgattttacagtagcaatgcccggcacgttaccgggcaaatgcggcgatgacaagccttactgctcatacagttccaacggcagcccgtccggatcgttaaagaacgtgaagcgtttttgcgtgtatggatcgacacggatggcttcacacttcacgttatggctttcaaggtgcgccactgccgcatcgatatcatcaacgctaaaagccagatgacgcaggccgcaagcttccggtcggctggggcgctccggcgggaacggaaatgagaaaagctcaatcacatattgcccattaagcgccaaatcccctttccacgagtcgcgcgcttcgcgatagacttcgctttgcagcgtgaaaccaagaatatcgcagtagaaagctttgctcaccgcataatccgtcgcaataatcgcaatatggtgaacctgttttaaacccagcataacgtctcctttatttgttaacagcacgttactcgcccggaagccgctctggcaagttatcccgccatttttaggactcgtacgcggtaaacgccgtcttcgtcctgtttcgcgccgtgaatatccgtttcaaaaccggggtaatgttgccctacggaacaaagcatcagtagaaaatcgagtactgtgcggctctctttggtcagcatttctcccggcatcagcagcggtacgccaggtggataaggcaggatcatatttgccgatactctaccgaccagttgttccagcgcaatggtttccacttcgcctttaatctgtctctgccatgcctgatgtggcgtcatgatcatctccggcaaggtatcaaatgcccgcaacatcaaaccgggaagatcgtgtttacgaatcagcttatggatcccttgcgccagatcctgaatgcgcatattgcggtagaaatcgggatcttcagcatagagatcgggcagcatatttttgatccgcaggttgagatcgtaagagcgcttaaattccgtcaacccacgcaataatcccattgctttggttttatcgattccaatactaaagagaaacagcaggttataaggaccggttttctctactacgatccctcgttcgtcgaggaattttgctaccagcgccgccgggatcccctcctcgctcatattgccctgctcgtccatccccggtgtcaaaatagtgactttaaccggatcgagaaacatatgatcggcatccgcatcgttaaagccgtgccactgttcgccaggcgcaacgggccagcattcggcttcatccacctgcggcggttgccagatatcgaaaaaccaaccgtcagactcttcccgcagccgctggacctctttgcgaaaatgcagcgcccgctccaccgaacggttaatcagccgtttgcccggattaccacgcagcatcgccgccgccgtctcaaccgaagcaacaatgggataactgggcgaggtggtggtatgcatcataaaggcttcgttaaacgcctcttcgtcatactcgcctttaatgtggatcagcgaagcctgcgataacgccgccagcattttgtgggtcgattgcgtttcgaagatcacttttcccgcaacacgctcgccgctcataccacttttaccctggtagatcggatgaaaatgggtgtacggcacccaggcggaatcgaagtggatcgaggggacatccagcgtctgtttgatccagtcggtgttgtagagcaagccatcataggttgagttggtgatcaccgcatgaaccggccattgtgcttgcgtggtggcagcgactttctcttcgatactgtcgcgagaaaattcacggcgcgggatcccaccaagaatccccaacgcattacgcgtcggtttcagccagactggcactacatcgttcatcatcaacagatgcgccagcgatttatgacaattgcggtcaattaacagcgtactgccggacggcgcggcgtacatacccacaattttgttagacgtcgatgttccgttggtaacgatataactctgttccgcgtcaaaagtccgcgcgatgtactcttctgcttccaggtgtggcccggtgtggtcgagcaacgaaccaagctcggtaaccgaaatagagacatcagccttaagagtattcccgccgaaaaaatcataaaacagacagccaaccgggcttttttgatatgcggtgccgcccatatgacccggcgtacaaaaggtgtacttccgctctttgacgtaggtaaacaaggctttcgtgaacggcggtgtaatgttatcaagatattcgtcggtgtactgacgcatacgaatggcgatatcttccgcctgccccagcgcatattcaaaaaaccagagcgccatccgcatatcctgcacgctgacatccatcgtcgagtgggtgttgatgaaggcataaagcgggagatattcattaagctgattgatatcgctacataaatcgagactgtactcatcccagtcaaaaatcacgccgcaaattcgagggttatgttcgataaatttcagcaaatcaacgctgttttgtggccagataatctgaaagccttgcgccaccagcgccgactccagttctttgatgggctcatctttataaaagacgccatgcggtcccataatggcaatgatgttcatgtgttcctcctggaaaatccttccttaatcatagcctgctcaaaccgtggcgataaaaaagggccaccgaagtgaccctttttcagaacttttgcgaattacgcgtaaccgtagctcatcaggcgctgataacgacgattttttaaatcttcagtgcttaacacgtcgagatcggccagatccgccagcagttgcgctttcaacgatgccgccatcgcttccgggttacgatgagcgccgcccagcggttccgggatgatggagtcgatcagtttcagctctttcagacgcggagcgatgatacccatcgcttcagccgccagcggcgctttgtcggcgctcttccacagaatggacgcacaaccttccggcgagataacggaataggtgctgtattgcagcatattcactttatcgcccacgccaatcgccagcgcgccgccagaaccaccttcaccgataacggtacaaatagtcggtacgctaaggcgagacatttcacgcaggttgcgtgcaatggcttcagactgaccgcgctcttctgcgcccacgcccggataagcccccggggtgtcgataaaggtgatgattggcattttaaagcgttcagccatttgcatcagacgcagtgctttgcggtaaccttctggcgctggcataccaaagttacggcgaattttttctttggtttcacgacctttttgatgaccaatgatcatcaccggacgaccatcgagacgggcgataccaccgacgatagctttatcgtctgcatacgcgcggtcgccagccagttcgtcaaattcatcaaatgccaggcgaacgtaatccagggtataaggacgctgtggatggcgtgccagttgcgcaatctgccatgcaccgagatcggcgaagattttacgcgtcagttctacgcttttttcacgcagacgatgcacttcttcatcgatgttaatatccagtttctcatcctgacggctaaccgcagtcagagaatcgattttcgcttccagctctgcaatcggctgttcaaaatcaaggaaattcagactcatagtattcctgtattagtcaaactccagttccacctgctccgaaccaatgaggccacggagatcgtttaataaacgatcgctcggagagacacgccacgtcgcgccaaaacgcaaccgcgcgcgtgcatccgccctctgatagtagagatgtactggaattgtcccagagcggtggggttccagagactgacggagtcggtttaaaagctggtcatcaatttgcctgtccgtcagcgagatagcaagcccgcgagcatatttttcccgggcttcgtcaatatccatcacttcgcgagcggtcattttaagcccaccgctgaagtcatcaaagctgacctgtccgctgacgataagtatgcggtctttttccagcaattgctggtatttatccagggcgtcagtaaacaacatcacttccagccgcccggaacggtcatccagcgtgcagataccgatacgattgccgcgcttggtgaccataacccgcgcggcaacaacgagccccgcagccgtgatgactttaccacgttctgtcgggtgcatgtctttcagccttacgcctccgacataacgctcaatctcttttaaatactggttgatagggtgtccggtcaggtacaggcctaacgtttcacgttccccatctaataccacctgctccggccacggttggcagctggcgtaggattgttcaatttgttccggctcttcggccagcacaccgaacatatcggcctgaccgatagcttccgctttcgcgtgttgatctgccgcttttaacgcatcgcccagcgagttcatcagcgccgcgcggtgtggcccaagacggtcaaacgccccggacatgatcagtttttccagtacccgccggtttaactttttggtgtcggtacgggcgcagagatcaaacagttcgcggaagtagccgcctttattacgggcttcgatgatcgcctcaatcggaccttcaccgacccctttgatcgcgccaataccatacacgatttcgccgtcgtcgttgacgtggaaatggtaaagaccggagtttatatccggcggcaggattttcagccccatccgccagcactcatccaccaggcccaccaccttctcggtattgtccatatcggcggtcattaccgccgccataaactccgccggatagtgcgctttcagccataacgtttgatatgacaccaaagcataggccgcagagtgcgatttgttaaatccgtaacccgcgaatttctccaccaggtcgaagattttcatcgccagttcggcgttgattccgttcttttctgcaccttcagcaaatacagaacgctgcttagccatctcttccggctttttcttacccatcgcacgacgcagcatatccgcgccaccgagggtataaccagaaagcacctgggcaatctgcatgacctgttcctgatacaggatgatgccgtaggttggctccagtaccggtttcaggctttcatgctgccactgcacgtccggataggagatctcttcgcgaccatgtttacggtcgataaagttatccaccatccctgattgcaacggaccggggcggaacagtgccaccagtgcgatcatatcttcgaagcagtcaggttgcagacgcttgatcaggtccttcatgccgcgcgattcaagctggaataccgcagtggtttccgagcgttgcagcatgtcgaagcttttcttatcatccagcgggatcgcggcgatatccagcggcggctcgccattcttcgcccgccgcttgttgatcatctccagcgcccagttgatgatggtgagcgtacgcaaaccaaggaagtcgaacttcaccagtccggcgtattcaacgtcgcttttatcaaactgggtgaccggatgtttgccctcttcatcgcagtaaagcggcgcaaaatcggtaattttggtcggtgcgataaccaccccaccggcgtgcttaccggcgttacgggtgaccccttccagtttgcgcgccatgtcgatcagcgccttaacttcttcatccgcttcgtagatttccggcagctgcggctcggcttcaaacgctttcgccagcgtcatccccggatcgggcgggatcagtttcgagatacgatcgacaaatccgtacggatgccccagtacacggcctacgtcgcggatcaccgctttcgccgccatcgtaccgaaggtgataatctgcgataccgcatcgcgaccgtacatgtccgccacatgttcgataacctggtcacgtttctccatacagaagtcaacgtcgaagtcaggcatggagacacgttccgggttaaggaaacgttcgaacagcaggtcaaattccagcggatcgagatcggtgatttttaacgcgtaggccaccagtgaccctgcaccagaaccacggcctggccctaccggtacaccgttatctttcgaccactggataaattccataacgatgaggaagtaacccgggaagcccatctggttgataacctgaagttcagtatccagacgttcgtcatactccggacgacgcttaagacgttcttcctcgtcagggaataaaaatgccagacgctcttccaggccctcttttgcacgcatgaccagataatcttcggtgctcatgtccccggtcgggaactgcggcaggaagtattcaccaagacgcacagttacgttacagcgtttggcgatctcaacggtgttggcaagggcttctgggatgtcggcaaacagctcgcacatctcctcttcgctacgcatatattgctgcggcgaatagttacgcgggcgtttaggatcgtcgagggtaaagccgtcgtggatcgcgacgcggatttcgtgtgcgtcaaagtcgctgctgtcgataaagcgcacgtcgttggtcgccacaacgggcaaaccgcgtgattccgccagttccaccgcagcgtgcagatagctttcttcgtccggcctgccggtgcggatcagctcgagaaaatagcgatccggaaagtgttcttcataaaacgcgacacactcatctaccagcgcgctgttaccacgcaaaagactgcgtccaacgtcgcccatgcgcccgccggaaagaaggatcaacccttcatttaattcgataagccagtcgcgatcgatgatcggcccggcggcaccgtacccgcgctgatacgcttttgagatcagcaacgtcagattctgatagccggtattgttcgccgccagcaccgtcaggtgggttaactcatcacccagcaggtcgcactggacgttaaaatccgccccgacgatgggcttaatccctgcgccatgtcccgctccgtagaacttcaccagaccgcaaaggttggtgaaatcggtgatcgccagtgctggcatacccaacgccgccgccttttttaccagcggtgcggttttggccaggccatcgatcatcgagtagtcgctgtgcacccgcaggtgtacgaaacgtggttcagacatcttcagattccggtttacttaatctcgacacaagaatcaggacgcaagtcccagtgcgcgtttgacaggcccaaagctgcgccgatggtgttcggtcgcgccgtgttcagccagtttttccagatgaaaagcggttggataccctttgtgttgggcaaaaccatattgcgggaaaacaatatccagcgccgccatttcggcgtcacgcgtcactttcgccaggatagacgcggcactgatttccggtacgcggctatcgcctttcaccacagccatcgaaggcatcggtaatttcgggcagcggttaccatcaatcaacacatattccggcgcaatatgcagtccagcgacggcacgctgcatcgccagcatggtcgcatgtaaaatattcagttcgtcgatttcgtgaggttccgcgcggcccagactccagctcaacgctttctctttgatctcttcacagagcgccagacggcgtttttcgctcagctttttggaatcattcagcccggcaattgggcgcgccgggtcaaggatcaccgcagcggtgacgaccgcgccaactaacggcccgcgtccgacttcatccacacccgcaaccagctgcgtgtgcggataaacaaattcgatcattgtgctaactccagaacggcttgtgccgcctgctcatcggcattgcagcggatctgctgatgcagttcacggaaggtgtcgtgcatcgcgtggctggttttcccgttcgccagcagcggtaacagcgccgcagccagtttttgcggctcacactcttcctgcaataactctttgactaactctctgcccgccagcaaattgggtagagagacgtaatcagttttcaccagtcgcttcgccagccagaaggtaaaaggcttcatgcgatatcccactaccatcgggcatttcgccagcatgcactccagtgctgccgtccccgacgccagtagtgccgcatcgctggcgaccatcgcctcacggcccaacccatccagcatatgaaccgacaggtctggcgcaacttcagctttgatgcgttcaaactgctcgcggcgtttggcattcaccagcggcaccacgatttcgagatccggatatgtctggcgcaaaagctgggccgttttcaggaaatcggcactaagcatttcgacttctgcaccacggctgcccggcaacaatgccagacagtgggcatcgtgagggatccccagtacatcacgggcaccatttttatctggatctaacggcatggcatcagccatggtatgaccgataaagcggcacggtacgttgtatttgtcataaaacgctttttcgaaaggcagaaatgcgagcaccagatcggtggctctgcctattttgaaaacgcgtttctgtcgccacgcccagacggacggactgacgtaatgaatggttttgataccctgctttttgaggttaccttcaagggtaatattgaagtcaggcgcatcaataccgacaaaaacatctggcttcagttcgccaaaacgcgttgtcagatcggcacgaatatgcagtaagcgacgcagacgcccgagcacttcaacaatgcccatcaccgccagctcttccatttcgtaccaggcttcgcagccttcagcctgcattcgtggcccggcaacaccaacaaagcgggcgttgggcacacgttctttcagagcgcggattaaaccggcccccaggatatcgccggaggtttctccggcgaccagggcaatcgttaatggacgctgttcagtcattaacgaatcagaccgcgcgttgagcgtgcaaagaaatcggtaaaggctttcacttccggatatgtttccgccagttcagcaatttccggtttcacttcatcgagcgttttaccgctacgataaatcagcttatacgcattgcggatagcggtaatcgcctcacggctgaatccgcggcgcttcagcccttcgatattgacaccgaacggcgttgcgtggttaccctgcgcaatgacataaggagggacgtcctgcgccacaccggagcagccgccaaccatcacgtgcgcaccaatgatgcagaactgatggactgcggtcatgccgccgatgatcgcgaagtcgtcaaccgatacgtgacccgccagcgttgcgttgttggcgagaatacagcggttacctaccgtacaatcgtgcgcaatgtgcgcgttgatcatcagtaagttgtcgctgcccaccttcgtcaatccaccgccctggactgtgccacgatgaatggtgacgctttcgcgaatgcggttacgatcgccgatttccacgcgggtcggttcgccagcatatttcagatcctggttaacttcgccgatggaggcgaactgataaatctcattatcgcggccaattttagtatgaccattcacgacaacgtgagatttcagtacggtaccctcaccaatttcgacatggggtccaacgatacaaaaaggaccaatgtgagcgttcgcgccaatcgacgcgccctcttccacaatggcggttggatgcacaaaggcggatttatcaatcacgtatcaggcctcccggctacgagcacacatcatcgttgcttcgcaaactactttaccgtcgaccagagcaacccctttaaaacgggtcaggccgcggcgcgttttttcgaaagtgacttccatgatcatttgatcgccaggcacgaccgggcgcttgaagcgcgcttcgtcaataccagcgaagtagtacagctcacccggttccagttttcctacgcttttaaacgccagaatacctgttgcctgtgccattgcttccagaatcagcacccccgggaaaatcggttttccagggaaatggccctggaagaatggctcattgacagagacattttttactgcgcgcagaaaacgaccttcttcaaaatccagcacgcgatccaccagtaagaacgggaaacggtgcggcagaagttctaaaatctcttcaatctgcagagtatgagtgttagtagtcaagatactcttcctgtcaaaatataagaaacgacaataataacacggcctgccgcaatcgtaagaatgagacaggccgtaaagtttggcgaacaaaagatggaacgttagtcttgttgattaaccttgcgctcaagcgatttcagacgcttgctcatgtcatcaatgttcatcaccagtgcagcggttttgcgccagactttgttgggttgcagcggaatgcctgaggaatagacgcctggttcagtgatgggacgcatcaccatacccatgcccgtaaccgtcactttgtcgcatatttccatatgcccgttgattacgctggctccgccgatcatgcagtaacgaccaattttcaggctgcccgccataatgacgccaccggcaaccgccgtattgtcgccaatcacgacgttatgtgcaatctggcactggttatcaatgatcacgccattgccaataacagtgtcatccagcgcgccgcgatcgatggtcgtacatgcgccgatctccacgcgatcgccaataattacgcgacctatctgcgggatcttcacccagttaccacgatcgttggcataaccaaagccgtctgcacctaccactgttccggactggatcaggcaattctgaccgatctggatctcatggtaaatggttacgttcgcccagagacgcgaacctgcaccgattttgctgtttttacctacgaagcaaccggcaccgataatcacgttatcgcccagttcaacgccggactcaatcacagcgttagcgccaatcgatacgttgttacccagcttcgccgtcgcgtcgatcaccgcactgggtgcaatgttctgcgcgggctgcggcgtggtatctaaaatttgcgccatgcgcgcgtaagtcaggtagggattcttcactaccagcgcggcacttttcgcgaaaggaagatcgtcctgggtcatgacaaccgcggacgcctggcacaagcctaaatgctcacggtattttgggttaaccatgaacgtgatgtgacctgtttgtgcagattgcatggacgcaacgccggtgatgacgatatcgccatcaccgtgtagttctgcatccaactgctgcgctaaatcagccagtcgaattgaaggcattacttatttaacctgtttcagtacgtcggcagtgatgtcttttacatcgctgctgttgtaagcaacggcgtttgcatcaacaaccagatcgatatcctggctgttggcaacggatttcacagcagtctggatacgagtaaccagtttgccgcgttcttcgttggaacgacgtgcgcgatcctgctcaaaagcctgcgctttctgagcaaaagtctggcgctgagccatcacgtctttttccagtttggtgcgatcgctgcccgctttcatggactgcagctttttcattttagcctgcagatcggtttccatacgctgcagttcgctggcacggcctttgaactcattttccagcgtgttagaaacaccggttttctgcgctacctgctggaacaggctgcccatattgacgattgcaattttgtcagccgcctgagcagaagttgccagtgctaaaccgagacctgcagctaataaccactttttcacaataaactccttaccatcccatttgcaccggagggtgcagttctttgcgtggcccggcgatcttatattgatcgcctaaagtcatcgctacactaccactacattcctttgtggagaacacttaccaggttttaccgatgttaaactggaactgttctgccttgtctccatcgtactttttgaacggctgggcgtaggagaacaccaacggccccaatggggacatccattgtaatgcgatacccgcagacatacggatattgcttggatcactatagtccggatatccagaatattggctggaatcccagtttgtatcccaaacggtacccatatcccagaagaaggaagtacgaaccgagttagcatacttgtcgctaatgaacggcgtcggggtgatgaactcgaggctggcaaccgccatagcgttaccgcctacagcatcatccgatttacacaggtctttcgcgccgtcctgagtcgcacattcgtaatcatagtccggatcataattactagcctgatgcgggaagtaaactgctttcggaccaatggtattggactggaagccacgcacggtgctggaaccaccggcatagaagttctcgtagaacggcatctctttgccgcctaaaccatcaccataaccccagcgggtacgacccagaacaacccatttgtgatcgtcatcgatcggcacataagtcgccgtgtctaacgtcactttgtagtattcgttatccgatcccggaatggtcactttaccggtcaggttgacacgtgaaccatctgtcgggaagtaaccacggtcaagcttgttgtaggtccaaccatagttgaacgtgaagtcgtccgttttgaagctgttatcctgatcagaggtgctcggatgttcacccatagagtacagataacgccacatcgcaacctgaggctgcatgttggacagggagttatgtacataacccagacctgcacgcagcgagttatattcgttgatcgggaagcccaacgtcacgtctgtaccataactcttgttggtatagtcggacaggtcggcgtcatctgcctggaagtcattatagaagagacgaccaccgaggcttacgccatctacggtgaagtacgggttggttaccgacagttcagcataggtctggtaatcgtttttggtcccgttgataccaacagcataacccgtacctaaccagttatcctgttgcacaccagcctggaagctcacgccactttcagtaccgtaaccaatcccgaagttgaagctaccggtgttacgttctttcaccttgtagactacatcaacctggtccgggctacccggaacacgttgggtatcggtatcgacagtttcaaagaagcccagacgattcagacgctccttaccctgatcgaccagatcgctccccagccatgcaccttccatctgacgcatttcgcgacgcaggacggcatctttcgaggtatcgttaccttcaaaacggatcttacgcacgtagaaacggttacccgcatcaacgttcacgcgtaatttaacggttttgtcggcatcgttaatttcaggcatcgactgtacgcgcggataggcataaccatagcgaccaagaagctttttaatgtcatcttccattttggtcactttggtgccgttatacagctcgcccggctcgatcttagtcagctgctcaatttcagcggagtgcccggcaaggttgccgctcacttcaacgccagaaagcttgtactgatcgccttcggtgatgttcaccgtgacgtaaataccttttttatctggcgtcagactgacctgggtagagtcgatgttgaaacgggcataaccgcgatccagatagtaactgcgcagggtttcaaggtcgcccgccagtttctgtttctggtatttacgatcgccgaccacgttccaccacggcacttcgtcacgcagttggaaatgagagatcagttcgtcggtggtgaaagcatggttaccaacaatgttaatttgctggatttcagctgacacaccttcctggaacaccagttttaggtcaacacggttgcgcggcagcggggtcacgacagctttaacgctggcgctatatttaccgacgctgtagtagaagtcttccagacctttctcgatatcggcaatggtggtgcgatcgagggattcgcccacacgcacgccagaagcctcgaggttttgcttcagcatgtcatctttcaccgatttgttaccggagaaagtaatgctggcaatggtcggacgttcttttacctgaaccagaagggtatcaccatcacgaaggacgcgaacatcctcaaagttgccggtagcaaacagagcgcgaatggtattactgatatcttcatcattaaccgtgtcgcctgtgcgcaccggcatactgaggagggccgcaccaacggcgacacgctgaaggccttcgaaatgaatatctttcactacgaacccttcagcaccgtatacggtggcgctgctaaacagcagcgacgctatgagcaactttttcatcgccatcgttattatgcgttcttcctaactaactctcataaccgagagaaatcattgaaaagtgcaagccccattaacagcaccagcaaaatcgagccaatgcgataacaaaagtcttgaacccgctcggataccggtccgcccttgatcttttcgatcgcaaggaacagcagatgccccccgtcaagtacgggcaacggaaacaggttaattatccctaagttcacgctaataagcgcaagaaacggcaggtaataaacaaccccgagttccgctgtcatcccagcccccttggcgatagagatcggcccactgaggttgttcagtttcacatcaccggtgatcaattttcccagcatactgaccgtcagcttcatcaactgccacgttttgtccgtggcttcgacgatggcgttgaacggcccatactggcgtacaactttatactcatcaggcaaaggaatgactttcggctcaataccgacaaaaccaatcgctttaccattacccggtttactctccgggattaatgtcaaagacaagggactcccctgcctttcgatttctaacgctaaggatttacccgggttatcccggacaagcatcacaaaggtcacccactgcgttaagggctgaccatcgactttaacgatcctgtcgcctgcttgcaaacctgccttgcttgccgccgagtttggctgcacattttccagtacaggttcaatttgcggcccacgaggacgaatccccagcgaagttaccggatcttctttatcaggctcaaacgcccagtgacgtaaatcgagctttacatcttgccgttggtcgctgccaaatggcgctaccgtaatggtggtgctttcatcgccaattttatcgaccaactgcaaacgcacggcatcccaatcaggcgtttcgataccatctacggcttttagttccgtacctggtgcaatttgtgcttccgcagctatcgaattggctgctatttcgccaaccaccggacgtacgccaggcacaccaataataaaaaccagccagtaggcaaagatagcaaaaatgaagtttgcaaccggacctgcggcaataatcgccgctcgttggccgacagatttattattgaaggcatggtggcggagttccggaaggaccggttctgcgcgctcatccagcattttgacataaccgcccaacgggatcagggcgataacatattcggtgccgagcttatcagttcgccgccagagcgccttaccaaaccctattgagaaacgctcaacgcgaacaccacaacgccgggcaacccagaaatgaccaaattcatgcacggtgataagtacacccagtgcaacgatgaacgaagccaaatcccagagaaaactcagcatattaccttccgttaaagcgtcctgaataccagtaacaacaagcaagcaaagaccggtaccgcagccgtcaggctatcaatacgatctaaaataccaccgtgtcctggaattaaatgaccgctgtccttaattcctgcttcacgcttaaacatactttcggtcagatcgccgagcactgaggctaacgctgcgacaatagagcaaatgagtaaggtgacgggagcgacgtcgagattcgcccacatgccataaccccatgagattaccgctgcagtcgcgagtccacctataaagccttgccaggttttacccggagaaaccttcggtgccagcttatgtttaccaaacaatttgccaaacatatatgcgccagagtcagcgccccataccaggatcatgacatagagcagccatattgcgccactgtaatgattctcgtcgtagtgccaggcccgtaacgccagcatgccccagaagaagggaacaatggttagcacgccaaaaataaggcgcaatgttttagagttacgccagattgctgcggaacctgggtaaaacagcaccagcaatagcgcgacaatccaccaacccagcgaagcccaaagtgagatttcaaccagcggttgatgaatatttcggtgatattccggcaacagaaaaagcatcagcgccaacaataacccgcataacaccgccaaccatactcgctgcgagcgagtggtaaaaccgctaagctgtccccattcccacgctgccagcatgcagaccaccagcgttacaatggcgaaccccaccggcggcaacagaaacaacgccgcgatgacgacgggtattaacacaaaagcagatatcaggcgatacttcagcaaaagcgacccccatcaggctgtttcatcaccgggctcggtaccgccgaaacgacgctctcgattagcaaaggcatttaacgccccttcaaagtcttgttcatcgaaatcgggccagagaacatctgtaaagtaaagttcggcataggcaatttgccaaagcaaaaagttactaatgcgatgctcccccccagtcctaattactaaatctacaggggccagttcatgcatacagacatgctggtttagcatctcttcatctatctgatctggttgcaggtttccttgctgcaccttttcagccagttgcctgactccctggactatatcccaacgtccaccgtagttcgccgcaatattcagcgtcagaccggtattcccggctgttagcgcttcagatttacgaatacgttcttgcaaacgcgagttaaagcgactggtatcgccaataatacgcagacgcacgttatgtcggtgcagactctttacttcgctatcaagcgcccacacaaacagttccattaacgcactgacttcctgcgctggtcggttccagttttcactactaaaggcatacagagttaacgcctcaataccgttgttggccgcaaaagagacagcccggcggacggattttgccccggctttatgcccaaaggcacgaatcttcccttgcttttttgcccagcgaccattgccgtccataatgatcgcaacatgacgacagccatgcgctggcaatttttcgctaagtggttgagtagcagacaacatcacgcgttttttattccctgacagggtttacggtactcaggaatactgaagcctatacaaaaaaaagccgtgtaaaaccacggcatacctgaccttataaagccaactacttacgatcagatggcgcagactatatcactgaagccctacgctaacaaatagcgcgactctctgtagccggattatcctcagcttgcgagacgcatcacctcttttctggcgacttcacgcgcgttcgcatcaacagataacacatcgtccacacattgtggttcgcgcatatccattttttccagtacggataaattcaacgcggcgatatccgtaaagcggatttgttgcgcaagaaaagcagcaacggtgatttcgtttgcggcattcaatgctgtcgtcgctgcctggccttgttcgaacgcctccatcgccagtttcaggcatggataacgatcataatccggtgcggcaaatgtcaacgcacttagtttgcaaaaatcgagcggcttcacgccagagttcacgcgattcggccatgccatggtgtgggcaattggcgtacgcatatccggttcccccagctgcgccagaacactgccgtcctgatagcgcaccattgagtgaatcactgactgcgggtgaatcagcacttccatctggctggcgctggcgttaaacagccaacgcgcttcaatgtattccagacctttgttcatcatggtagccgaatcgacagaaattttacgccccatcgaccagttcggatgacggcaggcttgatccggcgtcattgttgccaaatcgcgcaatggcgtctcacggaaagggccaccagacccggtaagtaaaatggacaccacgccattttgctcaaggtcagcgtatcccagattatgctggataggttgcggtaaactctgaaaaatggcgttatgttcgctatcgaccggtaacaattgcgctttgctctgctttacggcgtccataaacagacgtccgcaggtaaccagtgattctttattggccagcaaaatggttttacccgcgcggatcgcagcaagcgtaggtaacagcccagcagcgccaacaatggctgccatcacctgatcaacatcctcaagcgctgccatatcgcaagcggcttgttgcccacttaagacttcggtgcggctaccctgttgctgtagcatcgttttaagaagtttcgcactcgcttcatcgtccattacggcatagcggggagagaattccaggcactgttctaccatgcgagtgacatttttgcctgccaccagcgcaactacgcggaagtgttcgggattatggcgcaccacgtccagcgtgctgcaaccaatcgagccggtcgagcccagaatggtgagttgcttcatgaaacatccagagttgagacagaataaaaagcaaaacgccgccagccgatccgcaaggatctactgagcggcgtttttgtcgttcaagaaatcagaactgcatcagttctgcttctttgtctgccagcgccgcttcaattttcttgattgcagcatcagtcagtttctgtacatcgtcctgagaacggcgatcgtcgtcttcgctgatctctttatctttcaacagtgctttcactttgtcgttcgcgtcacgacgcacgttacgtactgcaacacgcgcttgttctgcttcaccacgaacgattttggtcagatctttacgacgttcttccgtcagcggcggcagcggaacacggatgtcgctacccgcagagttcgggttcaggccaagatcggacgccataatcgctttttcaacggccggagacattgaacgatcaaacacgttgattttcagagtacgggaatcttctaccgttacgcttgccagctgacgcagcggcgtcggcgtgccgtaatattccacgacaatgccatccagcaggctgggagaagcacgacccgtgcgtattttgctgatttgggttttgaacgcttctacgcatttgtccatgcgtacttcagcatcttttctgatatcgctaatcacgttacgaatccttgaaaacttgtctcagtcagaccagacagtcacacacagtggaagtgtgctaagtatagccctgattaaacatattacgggtaatcgtctggattattaggctattttatttgccattttggccccgggcagtgctcgccatcctcacgtacttgtgtacgctccggttgctgcgcgctggccgtgaccaaactgcctgcaacaataacgccttataaccagacttacgcccccgcgatacttacgcggaatcttacccttatttatccatcacgggaattattccgtgattaaagtcccttctttttcacccattaccacacggcgcagcgcacccggtttgttcatgttgaaaacacgaatcggtaatttatggtcacgagccagcgtgaaggccgccaggtccatgactttcagctctttttccagcacttcgctgtaagtcagttgctcgtacatggttgcagttggatctttcgccggatcagcagtaaacacaccgtcaactttggttgctttcagcaccacatcggcttcaatttcgataccacgcaggcacgctgctgagtcggtggtaaagaacgggttacctgtaccggcggagaggatcaccacacggttgttgcgcaacaggctgatagcttctgcccagctgtagctgtcgcacacgccattcaatggaatagcggacatcagacgagcgttcacataggcgcggtgcagtgcatcacgcattgccaggccgttcattacggtcgccagcatccccatgtggtcgcccacaacgcggttcatacccgctttcgccagaccagcgccacggaacaggttacccccaccaatcaccacaccaacctgaatacccagttcaaccagttctttgatttcctgagccatgcgatccagtatgcttgcatcaataccgaagccttcagtgccctgcagagcttcgccactcaacttaagcagaatgcgtttatagacgggttttgcattggtagccatgtttctttcctgagactgtcaacgattgaaatgaattaatactagcgacattgtacgtcgcttttcagcgcagccccacaagggttagctgaatttacaagatgggcacaaaaagaagccgccctcaggcggctccttttcgataattaagactgcttggacatcgcagcaacttctgctgcaaagtcagtctcaactttctcgatgccttcacccacttcgaagcggatgaagccagtcacttcagcgttatgctctttcagcagctgaccaacagttttgcttggttccataacgaacggctgaccggtcagagaaacttcgccggtgaatttcttcatgcggccttcaaccattttctctgcgatttctttcggcttaccagactgcatcgcgatatccagctgtacctggtattctttttctaccacttcagcggatacgtcttctggtttgatgaattctggcttgcttgcagcaacgtgcatagcgatgtgtttaaccagctcttcgtcagcgcctttagcagcaaccagaacaccgatacgcgcaccgtgctgataagaacccagaacgtcgccttccagcgcagcaacgcggcgaatgttgatgttttcaccaattttcgctaccagcgcaacacgttcttcttcgaactgtgctttcagaacttcaacgtcagtgattttgccagcaacagctgcgtccagaactttgtctgcgaacgcctggaaaccagcgtcttttgcaacgaagtcagtctggcagttaacttccagaatgatgccgtagttgccgtcgattttggttttgatcacgccgtcagcagcaacgttgcctgcttttttcgctgctttaatagcaccagacttacgcatgttttcgattgccagctcgatgtcgccgttagcttcagtcagtgcttttttgcaatccatcatgcctgcgccagtacgctcacgcagctcttttaccagggatgcggtaatttcagccattctaaaatcctcggagatgtgatctgcccggcattaaaccgcacagatataaaagtgaaaaagggggccatatgcaggccccctaaccaaacgtgtactacctggtctataagggctctcccccttcatatttcgcgccgcagatgcgttatcttcgctcgctcatcccggtcacttactgatgtaagctcccgggaattctcgagcttgccgcctttctgcaactcgaactattttgggggagttatcaagccttattactcagcttctacgaagctttcttccgcctgggaagccagatcctgagaacggccttcacgtacggttgcagcaacagcgcccaggtacagggtcacagcacggattgcgtcgtcgttacccgggataacgaagtcaacaccgtccggatcagagttggtatcaacgatagcaaataccggaatacccaggttgtttgcttctttgatagcaatgtgttcgtggtcagcatcgattacaaacagagcgtccggcagaccgcccatgtctttgataccgcccaggctgttttccagtttctccagctcacgagtgcgcatcagcgcttctttcttggtcagcttgtcgaaagtaccgtcctgagactgagtttccaggtctttcagacgtttgatggactgacgaacggttttccagttagtcagcataccgcccagccagcgatggttcacgaagaactggtcgcagctcagagcagcgtctttcaccgcttcgcttgcagcgcgtttagtaccaacgaaaaggattttacctttgcgagaagcaatcttgttcagttcagccagagcttcgttgaacatcggtacagttttctcaaggttgatgatgtgaactttgttacgcgcaccgaagatgaacggcttcattttcgggttccagtaacgggtctggtgaccgaagtgaacaccagccttgagcatgtcgcgcatggaaacagttgccatgattaaaacctctatataaaagttggggttatgcctccacgtatcccatattaccgaccccaaagggcaccccggaatatgtgtcgatacgtgtgtgttgttacacaaagtgagattgtcgcttccgtccagtctgtgtatacgaaatggatcggaagtccggcgcgctttataccacaaatacgtcgcggacaccaataattgttggcgctgtgtacagcatcagacgttgaattttctattatagaaaaccttcagtggcacgtttggcgaaattcagaatgattctcaatttgcccgggtgtgataccattgacggcacttacatatatattgtcggtatcaccgacgctgatggacagaattaatggctatctcaatcaagaccccagaagatatcgaaaaaatgcgcgtcgctggccgactggctgccgaagtgctggagatgatcgaaccgtatgttaaaccgggcgtcagcaccggcgagctggatcgcatctgtaatgattacattgttaatgaacaacacgcggtttctgcctgcctcggctatcacggctatccgaaatccgtttgcatttctattaatgaagtggtgtgccacggtatcccggacgacgccaagctgctgaaagatggcgatatcgttaacattgatgtcaccgtaatcaaagatggtttccacggcgatacctcgaaaatgtttatcgtcggtaagccgaccatcatgggcgaacgtctgtgccgcatcacgcaagaaagcctgtacctggcgctgcgcatggtaaaacctggcattaatctgcgcgaaatcggtgcggcaattcagaagtttgtcgaagcagaaggcttctccgtcgttcgtgaatattgtggacacggtattggtcgcggcttccatgaagaaccgcaggtgctgcactatgactcccgtgaaaccaacgtcgtgctgaaaccggggatgaccttcaccatcgagccaatggtcaacgcgggtaaaaaagagatccgcaccatgaaagatggctggacggtaaaaaccaaagatcgcagcttgtctgcacaatacgagcatactattgtggtgactgataacggctgcgaaattttgacgctacgcaaggatgacaccatcccggcgataatctcgcacgacgaataagatgaagccggcgaatgccggcttttttaatgcgataatttaatcttatgggtggcgcacaatgaatacccttccagaacagtacgcaaacaccgctctccccaccctgcccggtcaaccgcaaaatccatgcgcctggccccgtgatgaattaaccgtctgtgggataaaagcccatatcgatactttccagcgttggctgggtgatgcctttgacaatgggatctccgcagaacagttgattgaggcacgtaccgagttcatagaccagctcctgcaacgattatggattgaagcgggattcagccagattgccgacctggcattggttgccgtcggtggttatggtcgtggcgagctgcatccactttccgacatcgatttactgattttaagccgtaaaaagctcccggatgatcaggcgcaaaaagtgggcgagctgttaacgctgctctgggatgtgaagctggaagtcggtcatagcgtgcgcacgcttgaagagtgcatgctggaagggttatcggatttaaccgtcgccaccaatttaatcgaatcccgcttattaattggcgatgttgcgctgttcctcgaactgcaaaaacatattttcagcgaaggattctggccttccgacaagttctacgcagcgaaagttgaagaacagaaccaacgccatcagcgttaccacggcaccagctacaaccttgagccagacatcaaaagtagccccggcggcttgcgcgatatccacacgctgcaatgggtggcccgccgtcattttggcgcaacatcgttggatgaaatggtcgggtttggcttcttaacctcagcggagcgagcggaattaaacgaatgtctgcatatattgtggcgtattcgctttgccctgcatcttgtcgtcagccgttacgataatcgcctgttattcgatcgccagcttagcgtcgcccagcgtttgaattacagtggcgaaggtaacgaaccggtcgagcggatgatgaaggattacttccgcgttacacgccgcgtcagcgaactcaaccagatgctgctgcaactgttcgatgaagccatcctcgccctgcccgccgacgaaaaaccacgtccaatcgacgatgagtttcagctacgcggtacgctgatcgacctgcgtgatgaaacactatttatgcgccagccggaagccatcttgcgtatgttctacaccatggtgcgcaacagtgcgatcactggcatttactctaccacgctgcgccagttacgccacgcccgtcgccatttgcaacaaccgctgtgtaatattccggaagcgcgaaaactgtttttgagcattctgcgtcaccctggtgcggtgcgtcgcggactattaccgatgcatcgtcatagcgtgctcggcgcgtatatgccccaatggtcgcatatcgtcgggcagatgcagtttgacctgttccacgcctacacggtggatgaacatactattcgcgtgatgctgaaactggagagttttgccagtgaagaaacacgccagcgccatccgttgtgtgtggacgtctggccgcgcctgccgtcaactgagctgattttcatcgccgcgctgtttcacgatatcgccaaagggcgtggcggcgaccactccattctcggtgcacaagacgtggtgcattttgccgaactccacgggcttaactcgcgcgaaacacagctggtggcgtggctggttcgccagcacctgttgatgtcggtgaccgcccaacgccgcgatattcaggacccggaagtgatcaagcagtttgccgaagaagtgcaaacagaaaaccgacttcgttatctggtatgcctgacagtggccgatatatgcgccaccaacgaaacgctgtggaatagctggaagcaaagtctgttgcgcgaactctatttcgccaccgaaaagcagctacgacgcggaatgcaaaacacgccggatatgcgcgaacgggttcgccatcaccaactccaggcgctggcactactgcgcatggataacatcgacgaagaggcgctgcaccaaatttggtcacgctgtcgtgctaactattttgtccgccatagcccaaatcaactggcctggcatgcgcgccatttattacagcatgatttaagcaaaccgctggtattgcttagtccgcaggctacgcgtggaggcaccgagatttttatctggagcccggaccgcccctatctgtttgccgccgtctgtgccgaattagaccgccgcaatttaagtgttcacgacgcacaaattttcaccactcgcgacggtatggcgatggataccttcatcgtgctggaacccgatggcagcccgctatccgcagatcgtcatgaggttattcggtttggtctggagcaagtactgacacaaagtagctggcagccaccacagccgcgtcgtcaaccggctaaactacgtcactttactgttgaaaccgaagtgacgtttttgccaacccataccgaccgcaaatcgttccttgagcttatcgcgctcgaccagccaggactgctggcgagagtcgggaaaatttttgccgatctgggaatttcgcttcatggcgcccgaattacaaccattggcgagcgagtagaagatttattcataattgccaccgctgaccggcgtgcgcttaataacgagttgcagcaggaagtgcatcagcggttgacagaggccctcaatccaaacgataaagggtgatgtgtttactgatatgaaaagagtttaacaatgcagcagttacagaacattattgaaaccgcttttgaacgccgtgccgagatcacgccagccaatgcagacaccgttacccgcgaagcggtaaatcaggtgatcgccctgctggattccggcgcactgcgtgtagcggaaaaaattgacggtcagtgggtgacgcatcagtggttgaaaaaagcggtgctgctctctttccgtattaatgataatcaggtgatcgaaggggcagaaagccgctacttcgacaaagtgccgatgaaattcgctaactacgatgaagcacgtttccagaaagaaggcttccgcgtcgtgccaccagcggcagtgcgtcagggcgcgttcattgcccgtaacaccgtgctgatgccgtcttacgtcaacatcggcgcatatgttgatgaaggcacgatggttgatacctgggcgaccgtcggttcctgtgcgcagattggtaaaaacgtccacctttccggtggcgtgggtatcggcggcgtgctggagccgctgcaggctaacccgaccattattgaagataactgcttcatcggcgcgcgctctgaagtggttgaaggggtgattgtcgaagaaggttccgtcatctctatgggcgtatacattggtcagagcacccgtatttacgaccgtgaaaccggcgaaatccactacggtcgcgttccggcgggatctgtggttgtttcaggcaatctgccgtcgaaagatggcaaatacagtctttactgtgcggttatcgttaagaaagttgacgcgaaaactcgcggcaaagtcggcattaacgaactgctgcgtaccatcgactaaaagtatgcacacgggcagcacgacgctgcccgattgctttctggttcagaataattcgtcctactcattcttcttccccttttttaaatactttttcagcttgtttcggactgtcatgtaattcgcaaaacaaagataaatgtgctaatccatcccatggaatatcgccacaataaagcaggtaattttttgatttttacgccatgatagaagtctggaagaaaaaggctttctgcgatcacagtcgagccgggcgggccaggccaaatgctaaaataagcacaatttactgactcattttgaggtaacgctatgtacgacaatctgaaaagtctgggtattaccaatcctgaagaaattgatcgttacagcctccggcaggaagccaacaacgatattctgaaaatctatttccagaaagacaaaggcgagtttttcgccaagagcgtgaagtttaaatatccgcgtcagcgtaaaacggtggtcgctgatggtgtgggtcagggttataaagaagtacaggagattagccctaatcttcgctatatcattgatgagttagatcaaatctgccagcgtgaccgcagcgaagttgatcttaagcgtaagatcctcgacgacttacgtcacctggagtcagttgtaaccaataagatcagcgagattgaagccgatctggaaaaactaacgcgtaaataatgccattctgtgggccgggtaaagtctcacccggctgtaattttgtaatcgacctaccgctcttcatccagttgcaacgcgacatacagcagcaacctgtcatcaaaattgcccaaatccagcccggtcagttccgatatacgattaagccgatactccagagtattacgatgaataaacagcgcctttgacgtagccagcggttgcacattgtggcgaaaccacgccgccagcgttcgtcgcagcaagccgttattgtccatcgctttcagccgcgccagcggtcgcgccagttcgttggcctgccagtcgccacgcaaactgtcgagtaacacaggcaacatcagatcctgataaaaatagcagcgactttctggcattcgctgtttacccaccaccatcgtcgttttcgccgtacgataagagcgggcaatactgcccggtccggtaaaatagttacccagcgaaacgcgaaaacgcagctggccgtactctttcatgcgggtaatcagttgttcaactcgcttacgatgatcttctgcatcccagcgcccaaaagagttcaacgccggtttcaacaccaccatttcggtcagcgaaacaattgccaccagattattacgctcaggcgtagtcagcgcgttttgcagttgctgtaactccgccattgcgctgtccacgccaagctgaccgctgtcgacctcaacaatagccaccactcgcggttgattgagatcgatccccagccgttgcgcccattccgtaagtgcgggagtattctcctcagcctgaatcaggttcatcaccagttcttcccgcaaacggctatcctgcgccaacaggtgcatcaaccgcgactgttccagcatcatttcagccgtcatgcagaccagttcgccatatttacgcaggttctctggttcaccagtcaggccaataacgccgacaatttcaccttccagccgtaacggcagattaatcccctgccgcacaccgtgcagatgacgtgccaccgcgtcatcgatatcgacgactcgtccctgtgaaagtaccagcaatgctccttcgtgcaattcaccaatacgctcacgatcgccgctgccgataattcgcccgcgggcatccattacgttgatattagtatcgatgatgcgcatggtacgtgccacgatatcctgcgccattttggtatcaagatgccagccagccataagtcctccattatgcacggcttagcataaggaagtacgtaacgtacggcattgtgcaaatgcccaaaggatgatgaagatgtatggagttgtggcgaagttcacagattgtaaggagaaccccttcccgtattcaggaaggggttgagggagattactgcattaacaggtagatggtgctgtcgccgcgctgaatgttcagtgccagcacagacggtttgctgtcgagaactttacgcagttcagcgatgtttttcactgcctgctggttcgcgccaataatcacatcaccttttttcaggccgatctgcgcagccggagtgcccgttttcacgttgttcactaccacgccctgatctttgcctttgttgctcatctcagcgccttcaatgccgttgaagatggagctggaatcaacctgattctggctgctctgctgcagttccaggttcacgttaacctgcttaccgtcgcgcagtaagcccagggtcagtttgctgcccaccggcatagtacccacctgagcacgcagtgcggcaaagctgctgatcggcttaccgttcagtgaggtgatcacatcacccgctttaatgcccgcttttgcagcggaggagttaggcagaacctggcttacgaaagcaccgcgctgggcgtcaactttcatcgctttcgccagttcggagttcagctcagtccccataatacccagctcaccgcgtttcacctggccgtattccaccatctgcgaggtcaggtttttcaccatgttactcgggatagcaaaaccgataccgatgttgccgccgtccggtgcgaggatcgcggtgttgataccgatcagttcgccgttcaggttaaccagcgcaccaccggagttaccacggttgatcgctgcatcggtctggatgaagttttcgtagttttcagcattcaggccgctacgccccagcgcagagacaatcccggaagttaccgtctcgcccagaccaaacgggttaccaattgctacggtgtaatcacccacgcgcagtgcatcagaatccgccatcttaattgcggtcagatttttcgggttctggatctggatcagcgcgatatcagagcgcggatctttgccaaccatcttcgcgtcgaacttacgaccatcgctcagctggactttaatcaccgtcgcgttatcaacaacgtggttgttggtgacgacatagcctttatcggcatcaatgatgacgccggaacccagcgccatgaatttctgttgctggccgccgccattaccgccctggcccccctggcagaacggagagctctggaacggagaaccttcctggcagaacggagaatcatcaccgaagaactgctggaaattacgcggcatacgcggcgtattaacggttgtgctaccttctacgttaatgctgaccactgaaggcatcaccttttcgagcatcggtgcaaggcttggcatctgctgggctgtcgttgctgaagaagtctcagccgccgttgcagagagcggagataacgccaaacctaaactcagagccagtgcactcagtgctaatgtggtttttttcatgtatttcagtctcgattaacagataacgcaaaattgctgtgttcttcagattcgttttatagcgcgaagttccgaactaaagtttctgcaaaaggtaaaaatttattgttcgtctttacaaaagcctggttattgttctacggccatcagacgtcggtattcatcccaggcatagaggtcggtcataccgctgatataatcctgcagcaggcggcaacggtaataatattcccatagcggaaactcaggagaatctgacggtaatttactgacagcctcgacataggccagccgatggcgcgtcgagagtttgttgaataagcgcgattcaatagggaaacgtttcacccgttctttttctaccagttcagtaaagtctgataacgacaggcttaataaagggcgataaatctctaataatccgctaatgacccgatagccctgcaattcaagctgctcgacatctggatggctaaacacatgttttacagcgacatttttatataactttagaagatcgctgcattcgctggcatcttccaataatgcatgattaaacgttccggcgaaaatcgcaggcagattatcaataaatcgttgtgccgcgtagggtaccagtttatttagggtgtttacccgtaaatacataaaaaactgatcttccgtactgcggcttaaactatttgagcgtgatttttcccaggcattttcaaccaccagcgaaaagagcgaacctttctcatgctggccccacgcctcgtgcaaatgatgataaagctgctcaacggtaaatattcttttctctaccgcatcttcaagatctgccacacaataggagatgtcgtcggcagcttccataatccacgttaatggaaaacgactgtaaagcgccaaattaagttctttacgcaaccgggcaatataggcttcctcagaaagataataacccggctttttcattaaatagtgatgtgtctcaggcgtttcaccacgccaccacgccggacgagtatattttaaaataccgccaacctgtgcccaggtgagattcatccgcatcaatgtatgcaccagacgaatgccttgtgcattcccctcaaaatgacataagtcctgacgtattttgcgccgcagctcgttaagcggttcttccccgtcccgtaaacgtagtgctgccacgctgcagcgatcgtcagtcagaggctggctttcggcatcttccgggtgtaaacgttggcgaaaccagtcatttatcgctgcttcgccaaaatgaccaaacggcggattgccgatatcgtgcatcaggcatgacatctcaacaatgctttcaaaaggtccggtcagttcatccagaccgtatgcttccagcaatttaagctctttcagacggcttaaaatttctttggcgatgtagcgccccacctgctggacttccatcgagtgggtaagacgcgtgcgcacggcggcattgcgctccagtggaaaaacctgggtcttttgttgcagacgacgaattgccggagagttgatgatacgcccgcgatcgctctcgaagattcgcaggatctcatgttcggttttaacgccctgtggtgaacggtaacgacgatgccagtttattttttttcggaaatcaatctgtgccatgtcctctcccgcgtgagaaatacgcttccccgtaagcgcatggtaaactatgccttcaaatcgggcttatcgcgagtaaatctatgaaaatcggcatcattggtgcaatggaagaagaagttacgctgctgcgtgacaaaatcgaaaaccgtcaaactatcagtctcggcggttgcgaaatctataccggccaactgaatggaaccgaggttgcgcttctgaaatcgggcatcggtaaagtcgctgcggcgctgggtgccactctgctgttggaacactgcaagccagatgtgattattaacaccggttctgccggtggcctggcaccaacgctgaaagtgggcgatatcgttgtctcggacgaagcacgttatcacgacgcggatgtcacggcatttggttatgaatacggtcagttaccaggctgtccggcaggctttaaagctgacgataaactgatcgctgccgctgaggcctgcattgccgaactgaatcttaacgctgtacgtggcctgattgttagcggcgacgcattcatcaacggttctgttggtctggcgaaaatccgccacaacttcccacaggccattgctgtagagatggaagcgacggcaatcgcccatgtctgccacaatttcaacgtcccgtttgtcgtagtacgcgccatctccgacgtggccgatcaacagtctcatcttagcttcgatgagttcctggctgttgccgctaaacagtccagcctgatggttgagtcactggtgcagaaactggcacatggctaagtcactgttcagggcgctggtcgccctgtcttttcttgcgccactgtggctcaacgccgcgccgcgcgtcatcacgctttctcccgccaacactgaacttgcctttgccgccgggatcacgccggttggggtcagcagctattccgactatcctccacaagcgcaaaagattgagcaggtttccacctggcaggggatgaatctggaacgcattgtggcgctgaaacccgatctggtgattgcctggcgtggaggtaatgccgagcggcaggttgaccagctggcttcgctgggaataaaagtgatgtgggtcgatgcgacaagcattgaacaaattgccaatgcgttacgtcaactggccccctggagtccgcaaccagacaaggccgaacaagccgcgcaatccctgctggaccagtacgcgcaattgaaagcgcaatatgctgataaacctaaaaaacgtgtttttctgcaattcggcattaatccgccatttaccagtggaaaagagtcgattcagaaccaggtactcgaagtttgtggcggagaaaacatctttaaagatagccgggttccctggccgcaagttagccgcgaacaggtgttagcacgcgcgccacaggcgatagtcattacaggcggaccggaccaaattcctaaaatcaaacaatactggggtgaacagctcaaaattcccgttattcctctcacgagtgactggtttgaacgtgcaagcccacgtattatcctcgctgcacaacagctctgtaatgcgctttcacaggtagattagcgcctgaccttttcaggtgctcagtggggattgaacaatgctcgtctattggctggatatagtcggcacagcggtatttgctatctctggcgttttgttagccggaaaattgcgtatggacccttttggtgttctggtactgggcgtggttaccgcagtaggcggcggaacaattcgcgacatggcgctggatcacggcccggtattttgggtgaaagatcccaccgatctggtcgttgcaatggtaaccagcatgctgaccatcgtgctggtgcgccagccaagacgcttaccaaaatggatgttgccggtgctggacgccgttggtctggcggtgtttgtcggcattggcgtgaataaagcctttaatgcggaagccggtccgttaatcgcggtttgtatgggcgtcattactggcgttggcggcgggatcattcgtgatgtactggcccgcgaaatccccatgattttacgtacagaaatctacgcaacagcctgtattatcggcggtattgtccacgctacggcttattacacattttccgtaccactggaaacagccagtatgatgggcatggtcgtgacgctattgattcggctggcggctattcgttggcatcttaagctaccgacgtttgcgctggatgagaatgggcgttgaagagagaagatgtgccggatagtttatccggcacatgaacaacagattagatgctaaaggaagaaccgcaaccgcaggtgcttttcgcgttcgggttggtcacgatgaaacgagaaccttccagaccttcggtatagtcaacggaaccgccgaccagatattgcaggctcatcggatcaaccaccaggccaacgccctgtttttcgatggtcatatcgccttcgttcacctgatcatcaaaggtgaaaccatactggaagccgctgcaaccgccaccggtgatatacacgcgtaatttcagattcgggttatcttcgtcagcgatcaggcttttaactttgttggctgctgcgtcggtaaactccagcggcagtgctacgtcatcactcatattttgctccaaacgacatcggcaattgggcaaattctaacccaataataatcgccattatctaataccctggtatttcgttcaagtattctcgctggctgatgcggccttgcttcgcgccagttgctcagcttcctgttttgccagcgtgcgcgcaagaatcgccgagtatagcggtttcccgccggtaaattgcgctaatagtgttgcgccaagaccggtaataatcataggcaaaatgagctggtagttatcggtcatctccagaaccagaatgatccccgttaacggcgcgcgaatagatgccgccagtaatgcccccattccggcaatagcaaacgtccccgcctcaaggtggtattgcggaaacagctcaacggcaaccattccgaaagcggttcccagcacagtacccagcgccagcatcggggcaaaaataccgcccggcgcgccggaagagaagcagagtaaggtggtaatgacccgagcgacgaagataaacaccagcattcccatgctgaaattccccgcggtagcgataggaatcaggttaaaaccgccgcccgacgttgctggtgccacaaaccccagcaatccacacagaccgccaatcgcaccgcccatcagtacccatttggtaatattgccaccgtgcacacggtgcagcaaatcctgcatccccagcacccatttattaaaaatagggccgaaaatgccaaaaataataccgaggatcagataaagccacagcgtattaagcggcgcatcagaaagtttaccgacgtcaatcaacgcaacttcatgattaaaaatccggtacataatggtcgacataatgacgccaataaataccgctttaatcgaaattaacgtatagcgaaactgcggacgcatctcttcgataataaacaaaatacccgccagcggggcgttaaaggccgcagccagccccgccgcagcaccggttgccagcagcgtatggcgcgcttcatcacctttcaggcggaaaatatcaagcaccatgcgaccgatattgccgccgatctgtacggttggcccttcgcgccccagcaccatgcctccgccgagtgttcccagcccgccaaagaatttcaccggcaacacacgccaccagcgaacgggacgttgatcttccagcgccccttcaatttccgggatccccgaaccacctgcttccggcgcgtatttgcgcaccaaaaagtagccgaacatcgccagcaccgccgaacagagaaaagcgacagttaacagaagcggataattatcagcagtatgtaccagcgcccccatacgctggttctgcaaccaggcgacacctttgtcaaaagcaaccgcagccagcccgacaagcgtgccgacgactgccgccataaacaaaatggctaacggggttttatcgcgctcaagaagttggcgaatcagttgtctgcgtcgcaggcgcgcggcctgcggtgtttctaaagagggagtatcagttttcatccaatgatcacttattggtcatacaaataagatgacggcattttactcgcacgttccatgaaaatcctttgcaaagcgtaatgtttcaaatgcacaaaacttttatactctaagaaatcaggattgcaccagtacaagcagcctgatgtttgacgagtatttaacttgttatgaataacatagaatagcagccattcactttttctacgaatcaggaaccctccatgagtaagtctgaaaatctttacagcgcagcgcgcgagctgatccctggcggtgtgaactcccctgttcgcgcctttactggcgtgggcggcactccactgtttatcgaaaaagcggacggcgcttatctgtacgatgttgatggcaaagcctatatcgattatgtcggttcctgggggccgatggtgctgggccataaccatccggcgatccgcaatgccgtgattgaagccgccgagcgtggtttaagctttggtgcaccaaccgaaatggaagtgaaaatggcgcaactggtgaccgaactggtcccgaccatggatatggtgcgcatggtgaactccggcactgaagcgacaatgagcgccatccgcctggcccgtggttttaccggtcgcgataaaattattaaatttgaaggttgttaccacggtcacgctgactgcctgctggtgaaagccggttctggcgcactcacgttaggccagccaaactcgccgggcgttccggcagatttcgccaaacataccttaacctgtacttataacgatctggcctctgtacgcgccgcgtttgagcaatacccgcaagagattgcctgtattatcgtcgagccggtggcaggcaatatgaactgcgttccaccgctgccagagttcctgccaggtctgcgcgcgctgtgcgacgaatttggcgcgttgctgatcatcgatgaagtgatgaccggtttccgcgtagcgctagctggcgcacaggattattacggtgtggaaccggatctcacctgcctcggcaaaatcatcggcggtggaatgccggtaggcgcattcggtggtcgtcgtgatgtaatggatgcgctggccccgaccggtccggtctatcaggcgggtacgctttccggtaacccgattgcgatggctgctggtttcgcctgtctgaatgaagtcgcgcagccgggcgttcacgaaacgctggatgagctgacaacacgtctggcagaaggtctgctggaagcggcagaagaagccggaattccgctggtggtaaaccacgttggcggcatgttcggtattttctttaccgacgccgagtccgtgacgtgctatcaggatgtgatggcctgtgacgtggaacgctttaagcgtttcttccatatgatgctggacgaaggtgtttatctggcaccgtcagcgtttgaagcgggctttatgtctgtggcgcacagcatggaagatatcaataacaccatcgatgctgcacgtcgggtgtttgcgaagttgtgatgattttgcctcgcccaccgggcgaggcattcaattaacggctctgctttctcaacaaatagataaaatatggcgcgccgataaaggtcgacagcagccccgctgggatctggaatggaaacagcaccatccgcccacaccagtcagcgaacaccagcagtaatcctcccaccagcgccgaaattacgatgtgtggcatcgtccgtcgaaagcccatcatccgcgcaatatgcggtgccattaaaccaacaaaactcaacggtccaatggtcattgtcgcagtcgctgtcaggcaagccgctaacagcagcagcgcaattcgcgtcggcgtcagcgtcatccccacggctcgtgcggtatcacctcccagcggtaaaatggtcagccagcggcggcacagcggggtaatcgccagcaaaatcaccatcacaattccggtacgccagacctgcgcatcggtcgcgttgtaggtcgaaccggaaatccaggtcagcacttgcgccattcgcgggtcaccacttgcctgcaacatcatcaaaagcatggtgaacgcggtacttaacgccatccccgccagtaacatgcggtgtggggaaaatccaccgcggccggcggcgatcataatgatcaacagcgtcaccgccgcgccgagactgcctgcaggtaacagccagccaaaggcattacccggcaccagaaacagcatcaacaccacgccaaacgccgcgccggagctaatccccagcacttccgggcttgccatcgggttgccggccagccgctgaataatacagcccgccaccgccagcatgacgcccgcaaacagcgccgccataattcgcggccagcgccagggcatcaaatcctcgagcaacgccccgctcgcccacgtccagccgtgcgcatcacggccaaacgacagcgccaccaccactgccatcaacagcagcacgccgcccgcgagggcaaacgccagcacatgttggcgttcagcagcgacacgatcgttgaccttcatatccggcgcgctaatgctgcgtaaacgcggcagcagccaaagtagcagcggcgcacctatcaacgcagtgaccgaaccggtagaaacttccatccacacgcgagtcagccagaggatgatttgatcagaaagccacagaattaacgccccaatcagcgacgccagcatcaatcgtggcaacaaacgccgcgcccccagcatttttgccagcagcggcgcgaacaacccgataaagccgataatccccaccgcattcaccagcagcgcactgatgactatcgccagcgtcagcgccgccagacgcgcgagcgacaaggccagcccgaggttgcgcgccacgccatcatcaagccccatcagggttaacggacgaagtagcagtaacgtcagcatcacgccgcccagcaactgcggccataaacgctcaacgccgccccagtcggtttgcgtcagcgttccggtgctccacaggaacatgctttgcaactggtcatgatggaagataaccagtaactgattgattgccccacaataaaggctcactaccagccccgcgaggatcagcgttaccggcgacagccgtttcccccacgcgacgccaaagacaattaagccaacaacgcaagcccctgccagcgcagcaaactggctcgccatagcacctgggatcgcccagagcgtagtgacggtaatccccagttgcgcgcctgttgcaacgcccaacgtcgtcggttccgccagcgggttacgcagcacttgctgaaacagcacgcccaccagccccaggcccgcgcccaccagcagcgaaatcgccagacgcggcaacaagctgtagtgaaaaatcatctgctcgatgacgtcaatatccggcgaccaggcggcctgcgcccactggctgcgcggcagcgcttgcgaaaagttcatccaggtgagcgccgctgcgacaatcaccagcagcgccagcaataacgccgggaaaagcgcaattcgtttactcacgctttacctccgatggcgttatccagaatacgcacaaagtgcattgccgagagcgtcgcaccataaaaccagactgcaggtacgcgctgaaagcgtccggcgcggacaaacggcatagcctgccacagcggcgtcgccattagggcgtccatgtctttgctgttgtcgtgatcaaagcagagcacatcaacgtctttatacgctgccagacgatcaatactgacggcggtactgccccagaagttggtttccccttgccaggcatttgggatgccgtactcatcaagaatttcctggaacaagctgtttggaccgaagaccagcatatggcgcggatcgataagcgtcgtcagcaataacgggcgcgctccacgcttcacaaagcggggtttcatgctgcggataaagtcttcatattgcgctaaatgtgtttccgctgccctttgcaggttaagtaaatctgccatttccgtcagcgatttacgcgccatcgccagcggctgtttgccgtcactgaagttaaatccgcgacccggcgcaatacgtgccagcatttctggtgaagggccatatcctgccgaccagaccataaacgatggtttcatttcggtcagcagttcaaggttaggttctgtgcgcaaaccgacgtcgatcactgagtccggcaatggtggttcgctgacccacaggcgatagttgatggtatccgccacgccgtaaggcacgatgccgagcgccagcagtaattccaccggcaaccactccagcgccacaatacgattgggatcaatagccgccgcgtgggcagtattcatctgccataacaacggagaaagcgccatcgccgttaacagtcgacggcgcgaaataagaggtaagccgctcatcaataaacaaaactcacaggtgcagcacccgccggatgcggcagaatacccatcgggatgccataaatcatttcgagggtttcgccgcgcataatttccgcaggcgttccctgagcaatcatttcaccgccgcgcagggcgaccagataatcacagtagcgcgccgccatattaatatcgtgcagcacggcaatgaccgtcagaccacgttcctgacttaaacgatgcaccagcgccagcacgtcaacctggtgggcgatatccagcgccgaggtcggttcgtcgagcaacagacaacggctatcctgcgccaccagcatggcgatccacgcccgctgacgttcgccgccagagagactatcgaccagccgatgcgccagcggttttaagccaaccagcgagatagcttcctcgaccttttcgcgatctgccgcaccaaagcgccctagtgcgccatgccacgggtaacgaccaatcgccaccagttcacgcaccgtcatcccttctgccggaggaagctgctgcggcaaataagccactttgcgggcaaacgctttgctgctccagctttccagcggttgggcatcaagaagaatctccccttccgacggtggctggtgacgaccaagcattttgagcagagtggatttaccagaaccgttgtgaccaatcagaccggtcactttcccggcaggaaaggttaacgacagcggatgcaaaagcgtgcgcccgggcacacgaaaggagatattacgcagtgcaaaagtggtatcggaatgattcgtgtattcctgcataacagccaacttgtgaaacgggcacggaaatccgtgccccaaaagagaaattagaaacggaaggttgcggttgcaacgacctgacgttctgcgccccagaagcagccataggtgttaaagcagctggcgacgtattcacgatcgaacaggttgttgacatgcagcgccacgttggagccagccatgccgactcgtgccagatcataacgcactaacgcatccacgaccgtataacttcccactttaaaggagttagccggatcaccatagctggagccagtataacgaccaccggtgcccagcgtcagacctgaaagcggaccgtcaaagaaggtatagtcagcccacagcgaagccatgtgttttggcacctgtgcaggcgtattgcctttgtaggtagtatcggtagtgtattccgcatcggtataggtataagaaccaaccacgttaacactcgccgacagcgccgcttttgcttccagttctacaccacgagcgcgaatctcaccgccttcaatcgagaaattgggattattcggatccgccatcaggttgttggttttggtaagctgatacagtgcgcccgtcagcacaattgggcgatcttccggcacatatttcacaccaacttcatactgtttgcctttcgaaggtgcaaacagatcaccgtttgcatctgtcaaagatgctggctcaaacgactcactgtagctgaagtaaggcgttaccccgttgtcgaacaggtagtttacgccaccacgccaggtgaactgtttgtcatcacgatcggatttattaccgtaatcacggttgaaagatgactgttccgcccagtcatagcgaccacccagagtcaccagcaccttatcccactgcgcctgatcctgaacatacagaccggtttgtttctgtttaagcaaaacgcggtatgggcccgacggatccgggtgagcaccaaaatcaaagtcactacggtctaaattatagatatcagacggtgcaacggaaccggcgtaaccgaaccaggagtcaatatcattacgcatacgcataaagtcaacgccggtcagcagagtgtgttcaaccgagccggttgcgaatttactttgcaactgagtatcaacagagaagttttctaatttctcattatcgataacgtactgacgagtcagtgtatgattccattctgactgcgggatacttaaacatggactcgccttgagtgcatcgtcgtctttggtatacagcggatccgagcacatgccgtagccatatacgctcttttgcgagactttattttgcgcaaagcgcaggttctgacgcacagtaaaggtgtcgttaaattcgtgatcgaagctgtagcccaccatcttctcattacgtgaataggtgttgttcttcgccccttcattaaagtctgtcggcagacgcttaccgttcggcagcggctcaacggttccctctttcggcaaccagccgtaataaccggtttccggttcgttctggaagtaagaaaggaaagtgaaattggttttatcatccgggcgccaggtgaacgctggagcaatagcataacgctgctcttctgcccccttctgctgagcattggctgaacgcgcaataccagtcagacgataagagtaaacgccgtcatcatccagcgcatcactgaaatcaaaaccagtctggaacaggctgtcagtaccggctttaaactgaatttctttcagcggttctgtagtcgggcgcttgctgaccatgttcaacaggccgccagggctgcttttcccgtacagcacggataccggaccacgcatgatttcggcgcgctccagcatatacggatcgataactgcatcgttatagaagttgccctgcatcttcaggccattcagatagttgttctggctttggccgtcagcggcgaatccgcggatgatcaggtaatcgtaagtgttggatgcgccacgagttcccacggcaacgccaggagtgtagctaagagcttcttttaccgacttcggctgatgcagcgccatctcttcggcggtcacaacagaaatagactgtggcactttttgaatcggcgtatcggttttagtgccggtagctgactgtcgcgccgcaatagttgcagctggcccccatgcgctttcttgcggcgcaggtgcagcggtaacggtgatagtgtcttctttcggttcaaccgctgcctgtgcataaacagacatgccgctaaccgctgtggctactacaactgcgattttacgcagtgagtgttttggctgagcagttttggaacgcgccattggtatatctctgatgtaaagtgaatgataacgtaaacgagaatgattattataaagataagataatattcgaaacgctggcgggttcgcaagcggtacgcaatctgagcgttcctgaagggttaataaacaaccagatgaaaagaaagggttaatactttgggtgggatgttattttaccggatggctactcgccatccggtatgtcacgcttagacgttaattactaccaaacatatccttgatccaaccggctacaccgtcgctgtctttctgctcttgctgagcaggttgctgttgcggctgttgctgcggctgagaagactgatcaaacggattgcctgacggctgctgctgcatctcactctgctggcacagcgattgcggatcgctggtccagaccggcaagacacgcatgccaccgctgcaaacaaagttgccgtcgtagtccacgcccatatctgcaatatcttctggcggaacaagattcagcggcgttggcgtctggttagccagataacgctgataaatcgacattgccccgctggcaccatacagcttggtcggctggttgttatcacggcctacccaggtgatggtcaccgtgctgccgtcaatgcccgcaaaccaggtatctacgttattgttggtagtccctgttttccctgccagatgcaggttcgggtatttcgccccaagctgacgccccgtaccacgttgtaccacctgctgcatggtccatagtgtcagatacgccgcctgcgccggaaccgcgcgttccgcctgcgggaagctctgatacagcaccttgccatcttccgcgattaccgaacgcagtgcagaaagcggtgcacggttaccaccgctggcgatggtctggaatgcctgcgccacttcgattggcgttaagttcaacgcccccagcagcattgccggaaccggatgcagctgatctttcggtacgcccagtttaatccaggtctccgtaaccgcaggcagccccagcgccatccccagattcaccgtcggcacgttcatcgaacgggtcaacgcatccaccagcatcactctgccactttcgctataacgacggtcatcattctgcggtgaccagacctggccattcggctgacgcagcgcgattggcgcatcggcaatccacgtattcaaacgatagattttcggctggcttaaggccgtcagataagtcgctggttttgcaagggaaccaatcgaacgacgcgcctgcatcgcacggttgtagcccgcaaactgcggctcagaaccaccgaccatcgcacgaacttcaccgctaaagcggtcaacaaccacaatcgcggtttcaagatcgctcaacttacgctgtttcttcagtgccggaatgccttccacggcggctttttctgccgcgtcctgggccaccgagtcaaaggtagtgaagatcttcacgccggagagatcttttaccttatcgcccagttttgcctgcagctcctgacgcaccagctgcataaaggctggctgtggagagattaccccaccgcgcggctgaacgcccagcggacgtgcactcaacatgtcatagagttcttgatcaataatctgttgctgttgcagcagacgcagtaccagattacgtcgctccagcgccagtttcgggttacgccacgggttgtagatggacgcccctttcaccataccgactaacagcgcctgctggtcgaggcttagctcttctaccgggcgaccaaagtaatacaagcttgccagcgggaagccgcggatttcgttgtcgccgctctgaccgagatacacctcgttcatatacagctcaagaatacggtctttgctgtaacgcgcgtccatgatcagcgccatgtaagcttcgttcgctttacgccagtaagagcgctcgctggagaggaacaggtttttcaccagctgttgcgtcagcgtactcgcaccctgcaccgtgcgtccggctgtcaggtttgccagcaccgcacgtccgatggagtagagactgatcccatcatgctcgtagaaatgacggtcttctgtcgccagcaaagtatccaccagcaaatcagggaaaccactgcgcggcacaaacagacgctgctcaccgtttggcgaagagatcatggtgatcagacgcggatcaagacggaagaaaccgaactgacggttgttctccatattgacgatcgttgccagatgatcgccatcaaaggtcagacgcgcgcgcacctgcccttctttgctgtccgggaaatcaaacggacggcggatcatctcaatgctgttggcctgcacggtaaattcgccaggacgggtcattttcgacacctgacgatactgggtcgcctccagcagcttcaccatctcgttcttgctgatggtcatgtctggctcaaggttgaccatccggccataaactgccgcgggcaattgccagaccttgccatcaatacggctgcgaattttttgatcgagataaacgccgtaaatggcgatcagcacggcaaaaacgatagccagttttagcagcagccatagccagccgcgtttgccacgaggcttacgccctttgcctttgcccttacctttgcgcggcatcggttcttcatcctcatagtcatcataatcgtcgtaatcatcgtcatcttcgtaacgacgacggcttaccttttgtttgaccggacgcgtcggtttccctttgcgtccaattggctcgcggtcattcccggccatgctttttctccgcaatattcaggcgcaaaagcccgattttctgttcttctgttgcaagacagaagaagatatctctcaaatttactttgatcttcacgaatactttttcgttcgtcgcgttggtgctgtgtttgccgggtcgtccggccagacatgtttgggataacgccctttcatctctttttgcacctcacggtacgctcctttccagaaggcgctcaaatcacgcgtgatttgcagcggcctttgggcaggggaaagcaactccagcaccagcggcacgcgcccctgggcgatcgtcggattggtggcctcaccaaacatctcctgcattctcaccgccagcgcgggcggattatcttcatgataacgaatggcgatccggcttcccgtcggcacagtgtaatgcgcaggcaattcactatccagacgttgctgcattccccaatcaagtaatccgcgtagtgcctgataaatgtcgagtgatttcaggccgcgtagtgaatgcacgccgctcatatgcggcagtagccacgtttccagcgtcgccaacaaactctcatcatcaaccgctggccagtcatattccggcaaccactttgcggcgcataacaaacgcaagcgtagctgttccgcttccgccgtccagttgagcacgcttaaacctttatcacgaatgccgttaagcatcgcctgatgcaactcgtcttctgacggtttcgccagtggctgcactttcaccgtcaactgaccgatttgcagccgacgccaggctttcagcgtaccttgcgcgtcatcccattccacggtgtcagactgctgtaccagctgcgggcagcgttgtactaactcatcaatatcgaccggcagcgccagtaaaatccgcgcatccggcgaggcgctgccctgcaataataacggtgcgatcaaccattcgtggcggcttagcgcatcgtcggcatcgagcatcgcccccatgccgtttgccagttgatagcgtccatcttgcccacggcgacgagcaatgcgatcggcatacgccccggcaagtagcggcgcgataagagaactgtctgcctcaccgccgcgtacgtttaaacgttttaacagttgctgactacgttgctgccaggctggttgattgcgcgaaaacgccacgcccaggtcactattgcccatccgtggcggctcttcgagaatagcggcaatttttgccgcggtagcagcttcgtcgtcgctcttcgcgctaaccagcattgccgctaaacgcggatcgttacccagcgccgccattttttgcccttgcgcgcttagccgttcgccatccagcgcccccagcatccgtaacaggcgtttcgcggcctgtaaattcactgctggcggttgatccagccagctcatctgcgccggatcgctgcatccccattgcagtaattccatcagcaaaccggaaagatcgctttgtaatatctccggttcactttgcgcggcagcgcgttctgcttgttctttggcgattaaatgcaggcagatacccggctccagacgcccggcgcgcccggcacgctgcgtcatggatgcctgactaacgcgttgagtaatcaaccgcgtaagccccgtgcgcggatcaaaacgcgccacacgctcctgggcacaatccaccaccagacgaataccttcgatggttaaacttgtttcagcaatattggtcgccagcaccactttgcgcattccttgcggtgccggaaggatcgcttttcgctgatcgttcagcgacaacgcgccatacagcgggcagagcaacacatcactgccgatgcgcgaagccagttgttcctgcacacgctgaatttctccgacgccaggtaaaaataacagtaatgatccgctttcctgacgcagcatttcggcggtggctaccgcaacggcttcgtcaaaacgctgatgcgtgggcagtggtaaataacggcgttcaaccggaaacgagcgcccttctgagatgatgacgggcgcttctggcagcatttgctgcaagcggtcgttgtccagcgtagccgacataatcagcagtttaaggtcatcacgcagaccttgttgcacatcgagtaacagcgccaacgccaaatccgcctgcaagctgcgctcatgaaactcatcgaggatcaccaatccaacaccgctcagttccgggtcacgctggatcatgcgcgtcagcacgccttcggtaaccacttccaggcgggtattcggcccgacgcagttttgcgcacgcatccggtagccaacggtatcgcctggcttttcgttaagcagctccgccagccgttgcgcaacgttacgcgccgccaaacgacgcggctccaggaggataattttcccgttaatgccgggatgcgccagcagttgcagcggcagccaggttgatttcccggccccggtcggcgcagttaataacacctgcggtgcaccatcgagggcagcaagtaactcaggtaagacggcagcaacgggcaacgacgacacaaaacgctccagagggttaacattcttcgcgccacattgtagcatcgcggtaattcataaccgagtgcctcacatgtctgaaccgcaacggctgttctttgctatcgacttacctgcagaaatccgcgaacagattatccactggcgcgccacacacttcccacctgacgcgggacgtccggtcgccgccgataatttgcatctgactctggcatttttaggcgaagtgagcgccgagaaagagaaggcgctttctcttttagccgggcggattcgtcaaccgggtttcacactcacgcttgatgacgccggtcaatggctgcgttcgcgtgtggtgtggttagggatgcgtcagccgccacgcggcttaatccagctggcgaatatgctccgttcacaggctgcccacagcggttgttttcaaagcaatcgtccgtttcatccacatattaccttattgcgcgacgccagcgaggcggtgacaatcccgccgccaggttttaactggtcgtatacggtgacggagttcaccctttacgcctcctcgtttgcgcgtggacgcacacgctacacgccgctaaaacgctgggcgctaacgcaataacaaggattgtcgtaatggaattttctccccctctacagcgcgcgacgctaattcagcgttacaaacgttttttagccgatgtgatcacacccgatggtcgcgaattaacgctacactgcccgaatacgggtgcgatgaccggttgtgcaacgcctggcgataccgtctggtattcgacttcagacaacaccaaacggaaatacccacacacctgggaattgactcaaagccagagcggcgcaattatttgcgtcaatacgctttgggctaacaggttgacgaaagaggctatccttaatgaatcaatttcagaactgtcaggctatagctcgctgaaaagcgaagttaaatacggcgcagaacgcagccgtattgactttatgttgcaggcggattcgcgtccagactgctatattgaagtgaaatcggttacgttagcggaaaacgaacagggatattttcccgatgcggtcactgaacgaggtcagaaacaccttcgggagttgatgagcgtagcggctgaaggccagcgtgcggttatcttttttgccgtgctgcattcagccattacacggttttcacccgcgcgccacatcgatgagaaatacgcgcaactattgtcagaagctcaacagaggggggtagaaattctggcttacaaagcggaactttctgccgaaggcatggctcttaaaaaatcactaccggttacattgtagtagagtaagtaactggttaatttacattctggtcgcgtgcgcaaatacgcttttcctcacacagttgtcaagtgttacgtttagataattgctatccggaaaagcatctgctatttatagcggcctcatttttcccccgaacatggggatcgatagtgcgtgttaaggagaagcaacatgcaagaagggcaaaaccgtaaaacatcgtccctgagtattctcgccatcgctggggtggaaccatatcaggagaagccgggcgaagagtatatgaatgaagcccagctggcgcacttccgtcgtattctggaagcatggcgtaatcaactcagggatgaagtcgatcgcaccgttacacatatgcaggatgaagcagccaacttcccggacccggtagaccgtgcagcccaggaagaagagttcagcctcgaactgcgtaaccgcgatcgcgagcgtaagctgatcaaaaagatcgagaaaacgctgaaaaaagtggaagacgaagatttcggctactgcgaatcctgcggtgttgaaattggtattcgccgtctggaagcgcgcccgacagccgatctgtgcatcgactgcaaaacgctggctgaaattcgcgaaaaacagatggctggctaattacagccgttccatcacgtttaccacaggcgggaaatgctcccgccttattttttgttcaacgagatgacagacacacactatattggccgctttgccccctctccttccggcgagcttcattttggctctctgattgccgcgcttggcagctatttacaggctcgcgcccggcacggtcgctggctggtacgcattgaagatatcgacccgcctcgtgaagttcccggtgccgcagatactatcctgcgccagctggaacattacggcctgcactgggacggcgatgttctctggcaatcgcaacgtcaccacgcctatcgcgaagcactcgcctggttacatgagcaaggattaagttattactgcacctgcacgcgtgcgcgtattcaaagcattggcggtatttacgacggccattgccgggaattgcatcatggaccagacaacgccgcagtacgtatccgccagcagcatccggtcacccagtttactgacctgctgcgaggcattattcacgccgacgaaaaactggcacgggaagattttattattcatcgccgtgatggtttgtttgcctataacctggcggtggtggtggatgatcacttccagggcgtgagcgaaattgtccggggggcagatttgatcgaaccgacagtgcggcaaatctcgctgtaccagctttttggctggaaagtgccagattacatccatttaccgctggcgcttaatccacaaggcgctaaactttccaagcagaatcatgcgcctgcgttgccgaaaggcgatccacgcccggtgttaatcgcggcacttcattttctgggtcagcaggtagaaacacactggcaggatttcagcgtcgagcaaatccttcagtcagccgtcaaaaactggcggctcaccgcagtgcctgagtcggcaattgtaaattcaacattctcaaatgcgtcatgctgagctatgattagccgctatttttttgtcctgaatgatgtttgacactaccgaggtgtactatttttacccgagtcgctaatttttgccgcaaggtgctaagccgcgaggaaagcgaggctgaacaggcagtcgcccgtccacaggtgacggtgatcccgcgtgagcagcatgctatttcccgcaaagatatcagtgaaaatgccctgaaggtaatgtacaggctcaataaagcgggatacgaagcctggctggttggcggcggcgtgcgcgacctgttacttggcaaaaagccgaaagattttgacgtaaccactaacgccacgcctgaacaggtacgtaaactgttccgtaactgccgcctggtgggtcgccgtttccgtctggctcatgtgatgtttggcccggagattatcgaagttgcgaccttccgtggacatcacgaaggtaacgtcagcgaccgcacgacctcccaacgcgggcaaaacggtatgttgctgcgcgacaacattttcggctccatcgaagaagacgcccagcgccgcgatttcactatcaacagcctgtattacagcgtagcggattttaccgtccgtgattacgttggcggcatgaaggatctgaaagacggcgttatccgtctgattggtaacccggaaacgcgctaccgtgaagatccggtacggatgctgcgcgcggtacgttttgccgccaaattgggtatgcgtatcagtcctgaaaccgcagaaccgatccctcgcctcgctaccctgctgaacgatattccaccggcacgtctgtttgaagaatctttgaaactgctgcaagcgggctacggttacgaaacctataatctgctgtgtgaatatcacctgttccagccgctgttcccgaccattacccgctacttcacggaaaatggcgacagcccgatggagcggatcattgaacaggtgctgaagaataccgatacgcgtatccataacgatatgcgcgtgaacccggcgttcctgtttgccgccatgttctggtacccactgctggagacggcacagaagatcgcccaggaaagcggcctgacctatcacgacgctttcgcgctggcgatgaacgacgtgctggacgaagcctgccgttctctggcgatcccgaaacgtctgacgacgttaacccgcgatatctggcagttgcagttgcgtatgtcccgacgtcagggtaaacgcgcctggaaactgctggagcatcctaagttccgtgctgcttatgacctgttggccttgcgagctgaagttgaacgtaacgctgaactgcagcgtcttgtgaaatggtggggggagttccaggtttccgcgccaccagatcaaaaagggatgctcaacgagctggatgaagagccgtcaccgcgtcgccgttctcgtcgtccacgcaaacgcgcaccgcgtcgtgagggtaccgcatgacagtggcgtatattgccataggcagcaatctggcctctccgctggagcaggtcaatgctgccctgaaagcattaggcgatatccctgaaagccacattcttgccgtttcttcgttttaccgcactccaccgctggggccgcaagatcaacccgattacttaaacgcagccgtggcgctggaaacctctcttgcacctgaagagttactcaaccacacacaacgtattgagttacaacaaggtcgcgtccgtaaagcggaacgctgggggccgcgcacactggatctcgacatcatgctatttggtaatgaagtaataaataccgaacgcctgaccgttccgcactacgatatgaagaatcgtggatttatgctgtggccgctgtttgaaattgcgccggagctggtgtttcctgatggaacagtattaggaaatttattaaaaataaataaatttcatgaattaaacaaatggtgatttaatgatttcatgaatataaataaattccgaaaaatagccttaccccattgcaattaatatattccctaagctacaaccataattaatattatataccccgttaacaccttccgcctcacatacaatatttttcccgctttgtacattaagttttacttaaagatgaattaagtggatatataaatttaaatatgcacaatatcccacttggtgatgaacagatgttacattcagtaaatcttcacattcatcattaacaaaacaatctatttttctctatcggggttctttgtctgaaagcacccgattgtagttaaactcatggaatataattcaaggattattatgtctaaaaaattaggttttgccctgtctggtcttatgctggcaatggttgcaggtactgcttctgctgatatggacggtggtcagattaacatcagtggcttggttagcgataacacctgtgaaacaaaagttgatggcggcaagcaagatggcctggttcttctgcaaactgcaacggttgctgaaattaccgctggtgtatctgaaactgctgtcggtgccaaagcgaaaccgtttagcattactgtagactgcagcaaagcgactccgggaggccaaccgactctgacattcggttcagttttctttggtaacagtcgtggcactttgaataacgatatgtccatcaccaccccgtcatctggtgtgaatatcgccctgcacaacattgacggcaccactgttaaacaagtcaaaattaataatgcatctgatgcttacactaaagcattaaccaataatgttgcagtctttgacttcaaagcctcctatgttcgtgaagacgactcaacaccagcaacggctggttatgtaagaaccaacacagcttacaccatcacctacaattaagttattcgttggtgatttaaattactacaagggtgcgacacctattgtcgcccccttgtcttgaaaacaattcatgtcatggatggtatattttgttaaataaaaagaatattgtcgcattatgtgttgccagtagtatggcatttagtatgcctgttatggctgatattgttatttccggtacacgcgtcatttataaaagtgatcaaaaaagcgttagcgtacgcctggagaataaaggcaatagccatctgttagtacaaagctggctggataccggtgacgataacgctgagccgggaagcattaatgtaccatttacggcaacacctcccgtttcacgtattgatgctaaacgcggtcaaaccatcaaattgatgtataccggcagcaccgtactccccagcgacaaagaaagcgtattctggtttaacgtgctggaagtgcccccaaaaccagatgcttcaaaagtagagaatcagagcctgttacaactggctttccgtacccgtatcaagctgttctatcgtccggcaggattaaacggtaacccgtctgaagcaccattagccctgaaatggaaatgggctgaagggaagtctggcctgagtgtatataacccaacatcttattacgtctctttcaacagtgcagagttaatcgctggcggtaagtcgaacccgctcaatgtaaaaatggttgcaccgaaaagcgaagagattttcaccataagcggttcaggcgggaaagcaacgtcaggaaaggtacatttctccgcgattaatgattttggcggcgcaattgaaggcgatgtcaatttgtaagaccagggaccttatgcagcaggaagccaatgtaatgaaaacaaagacatcgactaaacgccataatcttacgcgtatcgcaatgtattgctcaatcatgtatagcggcgctaccatcggagccgaaagtgttgagtatgaccctacctttttaatgggtggcaacgcttccagtattgatgttagccgctatagcgatggcaacccgactttgcctggtgtttacgatgttagcatctatgttaacgagcaacctgttgctaacctggagatcccctttatcgcgatccccgataaaaagaatgctcaagcctgtattaccctgaaaaatctactacaactgcatatcaagacacccccggcagacgaggaaaatactatccttcttccacgggatgaaacgcttggcaactgtcttgacctgtcgttagccatacctaaatcctcagtgaactatgacccctctgaacaacgtctggatatcaatgttccccaggcatgggtgatgaagaattatcaaaactatgtggacccatcactttgggaaaatggcattaacgcggctacgctgtcttataacatcaacgcttatcgcagtgaaaattcaaattatacaaatgatagcgtttatacatcgttcaatggtggcgtcaatttaggggcctggcgtctgcgtagcagcggtaactatagctggagaaacgacgcgggaagcaatgttgagtttatgaatcgctacgtccagcgcgacattaccgctatccgctcgcagctcattatgggggaatcctacaccacaggtgaaacgttcgactccgttagtatccgcggcattcgcttatacagcgacagccgaatgctgccgcctgtattggcaaacttcgccccgacaattcgtggtgtagcaaatactaacgccaaagtcagcatcacccagagtggatacaaaatttatgaaaccactgttccaccgggaccttttgtcattgatgatctcagcccgtcagggtatggcagcgatcttatcgtaaccattgaagaagctgatggcagcaagcgtacattttctcagccattttcttcagtaattcaaatgctgcgcccgggtgtttctcgctgggatatcagcggcgggcaaattaataaagacgacttgcatcatgaaccaaacttactacaagcgacctattaccgtggtttaagtaacctgttcactggctatactggttttcaggtcacagataatcattatgctgcaggtttacttggcattgggatgaatacttcagtcggcgcaatttccttcgatgtcacccactccagtgtcgatataccggatgataaaaggtaccaggggcaaagctatcgcatctcctggaacaaattttttgacctgacagatacatcattaaacatcgcggcttaccgctactccacgcaggactatctgggcctgaatgatgcattaacacttattgatgaagttgaacatcccactcaggatcttgatcccaaaactatgcgcaactacgggcgcatgaaaaaccagttcaccgtaagcattaaccaaccgctacgctttgggaaggatgattatggctcgttctatacctctggaagctggtctgattactgggggggcagtaagagccgtagcaactattcggtcggctacagtaacagcgcttcatggggaagctacagtatcagcgctcaacgatcctgggatgagtacagccaaacagaaaacagtatttacctcagcttttcgatacctatcgaaaagctgatgggtacggagcaccgtgattccggtttccaaagtattgatacacaacttagtaccaatatggatggtaataatcagttcaacatgagcagtagcggttatagcaacgataaccgcgtgagctatagcgtgaacgcgggttatgggatgaataaaaccggcaaagatctcagcaacatcgggggttatgccagctatgaatcgccatggggaacgctagctgggtcagtctctgctaccagcgataataaccgccagtactccgttaatacagatggtggatttgtgttgcacagcggaggactgacgttcagcaacgacagtttcagtgataatgacaccattgctttggttaaagcaccgggtgcaaaaggggcgcgtattaactacggcaacaataccgttgaccgttggggatatggcgtaaccagtgctctttcaccataccaggaaaacaaaattgctctggacactgaaaacctggaaaacgacatcgaaatgaagagcaccagtacggttgccgtaccacgccagggctcggttatctttgctggttttgaaaccaatcagggacaatctgcgattatgaatatcaaacgcagtgacggaaaaggtatccccttcgccgccgatattcatgatgaaacaaatgcaatcattggcaacgttgggcagggcgggcaggcatttgttcgcggtattcagcagcagggcacgataaaaatcacctggctggaagccagcatgcccaaaacctgtattgcgcagtaccagcaacccaatgtgacatcggagaaaatccagcaaacgattattctcaataatattctttgccagctccaataatacgaaagagagatgacaatgataaaaaacacacggtataaaatagtactcctggcaggcatttttttactgcccggcgcactggcacaagatattaatgttgattttgttgccacaatcaaaggcacgacatgtaatatcactctggaagggacacgcgtcaccgctgatggcaataatcagtacacgctacggatattaaatgttgctctggataaaatcataaacaagatgccagaagcacaagccgactttaaactggtcgctaattgtgatggtaacataggcaagattacgacatcgctggcagggaatccttcagtagagttaccctatttaatttctccattaacttcagataattcatccaccacagaatatattgctatggggattaaacttcgaaatgcctctgacactgaatttattcccccagatggttctaaaaagatttcctggggagagggattaacaaaaccggaacttgagatgacggtagcacttcgcgaaacccgaccaggttcaggaagagcaggtaattttaaagcacttgcgacattcaatttcacctacgaataaaaggataataataatgcagatgaaatcattacattatgggatatttgcaagcattactctgagcttattattattcagcacgttttctatagccatcacggataacattggcctaaacgttatgaccactgttgaaaacagaacttgtcaaagcgaaatcagcaaccaggggttggttaaccttggcactgttggagtgggatattttgccagtaatgttagtgcggaagataattatccaggcggaaagacctttactgtgacagtaaaagattgcccctccgctggcacaacatcaagccagttgcatatagaatttaaacctgtcagtggtgtaatggccactggtagccaacagatattcgccaataatcatgtcggcggtgcacaaaatgtaggaatcgtgatttttagccaaaataatcagtcatcggacacagtgaatgtgctgtcaccaacagggcagtttcgcacagtctggccagttgcctctgcaaacatgaataattcatcgtggcaattttatacacgaatgcaaaaaattgatccgttacttcccgttggtgcaggatttgtcaccagcaatgtattagttgatatttattatcaataaatgccagacataacgcatctacaaatattattttttcaaaggagtgataagatgaagtcagcgttccgatactttctttttttatggattatcacagccagcattaataatgtaaatgctgaaaatcttacttttatggtcggtgacgatgctggcgtaggaaaccttaatggcccatcaggcgataaactaatatcattttcctatccggttggtggagtaaacaatattgtattttataatccaacatccaccacaccgaccaatgcaaaaataaaattatattggagtgaactggacacatcaagtagccgtgggtttgtatattgtacttcaaaaaataattccagcggtatgccaattactgtccggcataacatggttgactcaggaaaaatggcagatgggcacagattatatgaaactaatgtaaccggtctatattatacgttaatgctcaatagattctggtcgtatgaacttcgctcaagctctccagatatatacgttggagacgatggctggcacactgtacaattttctattacgggtgattatatacgaggtcaatgtaatacttccaggtatcaagcagtcggaggtcttttgcacgatgccacggtggaattctataccgacagcagttttaaccctgctccaaatactaacgtgcaattaaaacatactggtgattatttgtattcattcgcaaatgaagggccaggggttccaaatgtaagtgcatctaagatgctaaaaatcaattttaatttaacagacatcaatatccaactgccaacatgctttacgtctatccttttgggtgagagcgtaacgcgatcaaccgtaaatctcggggaatatactgttggacagatcacctcagattctgcaacacctgttaattttcagatctcgctacaaaattgtgttcgtataagcagtattaaaacaaaactaaaatctaatgtagtaggagtgaataatcctctgttgcttggtaatactttgacaggaaccgatgatgcaaaaggtgccggagtacttattgaagggttacccaacagcaaaaattcacaaaatttcacgcttaagccaaatgatgagacatcaagctataacgatgctgaagatgatcctggagaaaacaatggaatttataacccagattatcctaatgccaacggtcgtactacaacccaggacctgaaatttcaggcaacattaaaacgcgatggtaatgcaactgtgaaacccggcggatttaaggctaccagtacattccaggtcacctacgagtaacaggtttaaccgcaccgccatcatctggcggtgctgtaattgataaatcattgcccccaccaatgtgactgataaaatgccagacagcacgacattacttatcaggatacgttatgaaaccaaccactattgcttcattgcaaaaatgcaaacaagaaaaaaaacgtttcgcgaccatcaccgcttacgactatagcttcgcaaaactgtttgccgatgaagggcttaacgtcatgctggttggcgattcactgggcatgacggttcaggggcatgactcaactctgccagttaccgttgccgatatcgcctaccacactgctgctgtacgtcgcggtgcgccaaactgtctgctgctggctgatctgccgtttatggcgtatgccacaccagaacaagcctttgaaaacgccgcgactgtcatgcgtgccggtgccaacatggtcaaaattgagggcggtgagtggctggtagaaaccgtacaaatgctgaccgaacgtgccgttcctgtttgtggtcacttaggtttaaccccacagtcagtgaatattttcggtggctacaaagtccaggggcgcggcgatgaagcggccgatcgactgctcagcgatgcattagctttagaagctgctggggcacaactgctggtactggagtgcgtgccggttgaactggcaaaacgtattaccgaagcactggcgatcccggttattggcattggcgcaggcaacgtcactgacgggcaaattctcgtgatgcacgacgcattcggcattaccggcggtcatattcctaaattcgccaaaaatttcctcgccgaaacgggcgacatccgcgcggctgtgcggcagtatatggctgaagtggagtccggcgtttatccgggcgaagaacacagtttccattaaggagtgacgttgtgttaattatcgaaaccctgccgctgctgcgtcagcaaatccgccgcctgcgtatggaaggtaagcgcgtggcgctggtgcccaccatgggtaacctgcacgacggccatatgaagctggtcgacgaagccaaagcccgcgccgatgtggtcgtcgtcagtattttcgttaacccgatgcagttcgaccgcccggaagatctggcacgttatccacggaccttgcaagaggactgcgaaaagctgaacaagcgcaaagtggatttagttttcgccccttcggtaaaagagatctacccgaacggtacagaaacccacacctatgttgatgttcccggtctttctaccatgctggaaggtgccagccgtccgggacattttcgcggcgtttcgactatcgtcagcaagctgttcaatctggtccagccggacatcgcctgcttcggtgaaaaagattttcagcaactggcgctgatccgcaaaatggttgctgatatgggctttgatattgagattgtcggtgtgccaattatgcgcgccaaagacggtctggcgctgagttcccgtaacggttatctgacggcggaacaacgcaaaattgcgcctggtctgtacaaggttttaagttcgattgccgacaaattgcaggctggcgaacgggatctcgatgaaattattactattgccgggcaagaactgaatgaaaaaggcttccgcgccgatgatattcagattcgtgatgccgacaccttgctggaggtctctgaaaacagcaaacgtgcagtgattctggtagccgcctggcttggcgatgcccgcctgatcgacaacaaaatagtcgagctggtgtaatacttaactggcgctacggctgatggcgccagttattcattgccatgttatctgtaagcgataattcataacgcagacaacttagttagagttaattagcttatcaacctctgtaagagataaagttgccatctctgcaacgtcttcccgagacattcctttactcagaagacgctgtgccagccttaccttccggagtccctctttatatcccttctgaaatcccttctgaaatcccttctcttcaaaccactgcgccaacgtctgcctggtttctctccgtgtctttatttccataggttcccttaattatctggtcagttaacaataacaattatctggctataactgatgatgcagacaacttagttaatcagcttatcaatctcggcaaggggtaaatttgccatctctgcaacgtcttcccgagacattcctttactcagaagacgctgggcgaattcctgacttacttcctgtgttacttcctgtattacctcttgtcttacctcttgtcttacctcttgtcttacctcttgtcttacctcctgtcttccttcctgtcttcccctctcttcaaaccactgcgccagcgtcatcatagactcccctcccgtttccctgtctctcagcacaccataaaacaaatccgcttgttcagtatgaccgcgttgcagcatatagttttgcatggcaactaactgacttccgctagtgtacccttcgtcaatcagcgtgaccagttgctccagcaataacattaagtcgcgctggcgaatatgtttttgcagtagttcgagaatcgcaatccgccgatgctgcatgatttcgtcatccggtgtgatggtgatatccaccagcgggaaagggttgttgtaaacgcgtcgcgccagctccggcgagtaaaacatatcaaaccagcacattgagagcggataaggtgtggcctcgccctgataaaacagaatcggcaccaccagcggcagcttatcgtgatccgcctccagatgccggtgcatggcagcaatagaataacgcatcatgcgaaaggccattttcttatccggcttgctttgatgttcaatcaccacatgcaaataaccgggattaccctgcatttgcacggaatagagcacgtcagtgctgtgccctttcaggctttcttcaataaaactccccgactcaagatgcagcgtgtcgaggtcacacagttcgcgtagttccgctggcaaatggatatccagaaagtcacgagccgtttccgcatgcattaaaaattgtttaaataccgcgtcatgcggtgtggtactcggtgcatccatcttccctgccttccgtgttgtcttgcgtgaaggcagtatccagtcaaggcgcgccgtcgtcagccgcctctttattgtttaccgagcagcgttcagagaaatttcaattggttacaggcgttacatggcacgcttcggcacggtacgcaaactgctgatgcaaatgccgtcagatgagtagacactaaacaaaaatcgggcaatactgcgtgagaatttcctcaaagcaggcatcgcctgcttcgttaacgacagggtagaaaggtagaagttatgattcgcacgatgctgcagggcaaactccaccgcgtgaaagtgactcatgcggacctgcactatgaaggttcttgcgccattgaccaggattttcttgacgcagccggtattctcgaaaacgaagccattgatatctggaatgtcaccaacggcaagcgtttctccacttatgccatcgcggcagaacgcggttcgagaattatttccgttaacggtgcggcggcccactgcgccagcgtcggcgatattgtcatcatcgccagcttcgttaccatgccagatgaagaagctcgcacctggcggcccaacgtcgcctattttgaaggcgacaacgaaatgaaacgtaccgcgaaagccattccggtacaggttgcctgataatcacccctgcggctggttactcaccagccgcgacattgtctccagcgaatccgttcttaagatataaagtcgttttagtaacaacggattatcccccggttttactttgcctttcatggttgtcaccgccaggtgaaatccggcttcttttgctgccttcacggctttgtcattaaatccgccaaacggatacgaaagataccagacatgcggattaaattgcgccagagcgcggcgtgaacgtgcaaaatcaaacaggatattgtgctcactacggctcagtaatatgggtcggcgataaccatccacccgatgcaaaaaatgggtatgtgactggaaatcaaatacatcgcgaatttcgttaagttcagaaacgctcataaattgcagcgattttgggtcccacttctgcgggtgacgtttgatgcgcgaggtaacaataaacgccgtcgccttcatgccatattgtttcaacacaggatacgcatagcggctcaccgactttaggccatcatcaaaggtaatcaccaccgctcgcgcagggagattgatcttattcttcacgtaaccttccagttgcgccatgctcagtgtcacgtatcccctgtcgcgcagccaggccatctggttattgaaagcgcgtaccgaggtggtcgtcgaagtatggcgaaaacgggtattttcttcgtcgcgcagaatatggtgataggttagcaccggcaggccattatcgggttgggcatccagcgcgctgatataggccagtcgatcgccaatacggatctgataccaggtttgatttaacctgtctttcagtttatgcaaaattgggtagcgcaaattgtccgccagtaccccaaacggcgcactgcccgcactcggcgcgttgaagaccggcgtatctttccaggttattaagttctgattactcagcggcttgttgaggtcacccaaaccatcttcaactttttgtcgcccctgaaccggctcgagatgacctttatcgataaaccctttaccaaagccaaaattaaatgcgtaataacttgcggcagtgggctccacggcaatgatttgtccggcccgaatattccccaccgtcaccatcttgtcgccaatttgcgcccagaccgcagcattttcgatggtttgcatataacgggcaggtaacgcggcactgacacttgcggtaaacagcatcagcaggagaataacagcttgtttgtacatgaaaaaataaccgagggtgaaacaacgcttttattgtagcaaaagcgtcatcagaatcgcgggttaatactcatacaaattatgtttgaggacgaaaggcggatttttttgttgctggtgccaaagactactcacctccggcgcacccagttcgacaatacgctcgcgaaactctgcgctggataacgtttcacggtagaccagcatctgttcaattaacggtaacgtgacgccagaaatcacttcgcaacgggagtgtttgtggcttaataatgaagccacgcgatacggtggcgctccggctatatcggttaagaagatgacaccctcaccagagtccgcttcatgcagagcatcgcacatcatgcggctgagcatattagagcttaatccgcgccaaaaattcacggcccggcactgaagaagcaccccatgttttttctccagcgcatccagtatctcttgcgcccggtcatcgtgacaggtaattacccaacctaacatcgccttcctccttagccgaaaatcagtctaccctgaccattgttgataaagggtgatagccgtcaaaactcctctcccccaaatccagaggagaggaaatagccttagctacgcaaaccacgtccacgttggatcagcgaccaacagatcaaataaaacgccacaataaagaccaccagtacgccaaaggtagtgaccagcggaacatcattgataccgaggaagccgtagcggaaaccactgatcatataaacgattgggttcaggtgcgacagcccttgccagaacggcggcaacaaagtcagtgagtaaaacaccccgcccaaatacgtaagtggcgttaacacaaaggttggcaccaggctgatgtcatcgaacgttttggcaaacacgccgttcagcaaacccgcaagggagaacaacaccgccgtgagcaccagcgttaaagcgacaaatacccacgaatgcacctgaaacggcacaaaaaacagtgaaattgccgtgaccagaatgccaacaaacagaccacgcgccacgccaccgccgacatatccggcaataatgacgtgagtcggaaccggcgctaccagcagctcttcaatattacgctggaacttggcaccaaaaaatgatgacgcgacgttagcgtaggcgttggtaatcaccgacatcatgatcagccccggtacaatgaactgcatgtagctgaagccatgcatatcgccaatacgcgaaccaatcaggttaccgaagataataaagtaaagggtcatggtgatgactggcggcaccagcgtctgcacccagatacgcataaagcgatggatctctttcgcccagatgctttttagtgccacccagtaaagatgcatcatgcgcgatctccttgtttttcattaaccagtgaaacaaacagctcttccagacggttagctttgttacgcatacttaatacctgaatgccctgctcacttaactgcgtaaatacgctgttgatcccctgctcacgcagcacttcaacttccagcgtcgcggtatcgaccagtcgatactgatagccatcgagcttcggtaacgggcttttcggtgcgagatcgagaataaaggtttccgatttcagcttcgccagcagcgccttcatcgaagtattttctaccagctcaccgtgctgaataatgccgatattgcggcacagcatttctgcttcttccaggtagtgtgtggtgagaatgatggtggtgcctttgtcgtttaaatccttcaaaaagccccacattgagcggcgaagttcgatatccacgcctgcggtcggttcgtcgagaatcagtagtttaggttcatgcattaacgcacgggcaatcattaaacggcgcttcatcccgccagataacatgcgcgcacgttcgttgcgtttcccccatagatcgagctgtttaagatacttttcgctgcggatgtacgcttctttgcgctccacaccgtagtaccctgcctgattcaccacaatttgctgtacggtttcaaacgggttgaagttaaattcctgcggcaccagtcccaactgacgtttagcgttcacgacatccttctcgagatcgtaaccaaatacgctgacccgcccggaggttttatttaccagagagctgataataccgatagtggtcgatttcccggccccgttcggcccgagaagcgcataaaaatcacccgcttcgacctgcaaatctattccacgaagcgcctgaacgccgcctggataggtttttttaagctgttgaagttccagtgcaatggtcataaatttttacttaccttacgttcttacactttatctgtggtttaaatcgtcccggagttgccctatattagccaaacgtaattatttggttacaggtcgttaacctccatgaaagacatagatacactcatcagcaacaatgcactatggtcaaaaatgctggtggaagaggatcccgggttttttgagaaactggcacaagcgcaaaaaccgcgctttctatggattggatgttccgacagtcgcgttcctgcagaacgtttaaccggtcttgagccgggcgaactctttgttcaccgtaatgttgctaacctggtcattcacaccgacctgaactgcctttccgtggttcagtatgcagtggatgtactcgaagttgaacacattattatctgtggtcactacggttgcggcggcgtacaagccgcagttgaaaacccggaactggggcttatcaacaactggctgctgcatatccgcgatatctggttcaaacatagctcattgctcggcgaaatgccgcaagagcgccgtctggataccttgtgtgaactgaacgtcatggaacaggtgtataacctgggccactccaccattatgcaatcagcgtggaaacgcgggcagaaagtcaccattcacggctgggcctacggcattcacgacggcttgctgcgtgatctggatgtcacagcgaccaaccgcgaaactcttgagcaacgttaccgtcacgggatttccaatctcaagctgaaacacgccaaccacaaataaaaatgccatgccggatgcaacacatccggcaacttcacacttactcgtccagcagaatcactttgccgatatacggcagatgacggtaacgctgtgcgtaatcaatgccgtaacccaccacaaactcatccgggatcgagaaaccgatgaattctaccgggacgttcacttcacgacgggacggtttatccagcagcgtacaaatcgccaacgacttcggttcgcgcaggcttaagatctcacgcactttcgacagtgtattacccgagtcgatgatatcttcaacaatcagcacgtccttgccacggatatcttcatccagatctttgaggattttcacatcacgggtggtggacatgccgctaccgtagctggaggcggtcataaaatcgacttcatgagatacctgaacttcacgacacaggtccgccataaacataaatgagccacgcagcagacccaccagcaccatatcgctgccgctgtctttgtaacgctcagtaatctgacgacccagttcggcgatacgcgctttaatctccgcttcggggatcattacttctacagtatgtttcatatctctaaccatatgatttaaaaacaaatcacttcgcacgggcaggttttggcaccgcaacaaagcgcaagacacgcagtataccagtaaaactattcattcgcggaatctgttaataaagctcgaattgtgatgacgatcacacatgttaaaacctataattaattgctactaaaatattaatgaattgaaatggtgtctctttatggcaattaacaatacaggctcgcgacgattactcgtcacgctaacagccctttttgcagcgctttgcgggctgtatctactcattggcggaggctggctggtcgcgattggcggctcctggtactaccctatcgctggccttgtgatgctcggcgtcgcctggatgctgtggcgcagtaaacgcgccgcgctttggctatacgccgccctgctgctcggcaccatgatttggggcgtctgggaagttggtttcgacttctgggcgctgactccgcgcagcgacattctggtcttcttcggcatctggctgatcctgccgtttgtctggcgtcgcctggtcattcctgccagcggcgcagttgccgctctggtggtggcgttgctgattagtggcggaatcctcacctgggcgggatttaacgatccgcaggaaatcaacggcaccttaagcgccgatgccacacctgccgaagcaatctcccccgttgccgatcaggactggcctgcctatggtcgtaatcaggaaggtcaacgcttttcacctctgaaacaaattaacgccgataacgttcacaagctgaaagaagcctgggtgttccgtactggcgatgtgaagcagccgaacgatccgggtgaaatcaccaatgaagtgacgccaattaaagtgggcgacaccctttacctgtgtaccgcgcaccagcgcctgtttgcgctcgatgccgccagcggtaaagagaaatggcattacgatcctgagctgaaaaccaacgagtccttccagcatgtaacctgtcgtggcgtctcttatcatgaagccaaagcagaaactgcctcgccagaagtgatggcggattgcccgcgtcgtatcattcttccggtgaatgatggtcgtctgattgcgattaacgctgaaaacggcaagctgtgcgaaaccttcgctaataaaggcgtgctcaatctgcaaagcaatatgccggacaccaagccgggtctgtatgagccgacttcgccgccgattatcaccgataaaaccatcgtgatggccggttcagtcaccgacaacttctcaacccgcgaaacgtctggcgtgatccgtggttttgatgtcaacaccggggagctgttgtgggcttttgatcctggtgcgaaagatcctaacgcaatcccgtctgacgaacacacctttacctttaactcgccaaactcgtgggcaccagcggcctatgatgcgaagctggatctggtgtatctgccgatgggcgtgaccacgccggatatctggggcggtaatcgcacaccggaacaggaacgttatgccagctcgattctggcgctgaatgccactaccgggaaactggcgtggagctaccagaccgttcaccacgacctgtgggatatggatcttccggcacagccgacgctggcggacatcaccgttaacggtcaaaaggttccggtcatttatgctccagcgaaaaccggcaacatttttgtgctcgatcgtcgtaatggtgaactggtggttccggccccggaaaaaccggttccccaaggtgcagcgaaaggcgattacgtcaccccgacccaaccgttctctgaactgagcttccgtccgacgaaagatttaagcggtgcggatatgtggggagccaccatgtttgaccagctggtgtgccgcgtgatgttccaccagatgcgctatgaaggcattttcaccccgccatctgaacagggtacgctggtcttccctggtaacctggggatgttcgaatggggcgggatttccgttgatccgaatcgtgaagtggcaattgccaacccaatggcactgccgtttgtttcgaaactgatcccacgcggtcctggtaacccgatggagcagccgaaagacgccaaaggcacgggtacggaatccggcattcagccgcagtacggtgtaccgtatggcgtcacgctcaatccgttcctctcaccttttggtctgccgtgtaaacagccagcatggggctatatttcggcgctggatctgaaaaccaacgaagtggtgtggaagaaacgcattggtactccgcaggacagtatgccgttcccgatgccggttccggtgccgttcaatatggggatgccgatgctgggcgggccaatctccacggcgggtaacgtgctgtttatcgccgctacggcagacaactacctgcgcgcttacaacatgagcaacggtgaaaaactgtggcagggtcgtttaccagcgggtggtcaggctacgccaatgacctatgaagtgaatggtaagcagtatgtggtgatctccgcaggcggtcacggttcatttggtacgaagatgggcgactatattgtggcttatgcgctgccggatgatgtgaagtaaccataatgcccggagagatccgggcatatttccgaatacggtctttttataccgtaaaccctaacatcatccccgtatcttcatgctccagcagatggcagtgcgccatataagcatgttctttcggtgcctcgtgattaaacttcaccagcacttcgctgacattaccttctaccttaacggtatctttccagcccgcgcgatgagtcgctggcggtttgccattttctgacaagatacggaactgcgtaccgtggatatggaacggatgcagcatcatgtcgcccacgccagagataacccaacgttcgtattgccctttcgccgccgcaaacatcggcttgttcatatcaaacgcctgaccgttgattttattggcatggtggaaatcgaacttcccgccgtggttcatatgattcatattgccgtgccccatatggcccatcatctggctgtgatccattccggccatcgcctgatcgccatatttctccattagcatctgcatccccatcatatcgagcatcgggtccatagaaagttgcagcttgcgtaccgtcagcccttccagcgaaggtaacgcaggcaggctacttaatgtgtctggcaaagcaccggaggcactaatagcaatcggctgaatccgcattaccggatgcggcttgtcaaacggtgcaatcgccatccccatctggctgaccggcagcgtcaccaggtcaaagggtttgttgtcgttaacctccaccagcacttcaaaacgctcgcccatcagcaccggcagttcgctcaccttcaccggttcaggtagcagaccaccgtcgctggcaatcacataaagcgggcgattgtcgctggtggcgaaattgagcgagcgggcgttacagccattgagcaaacgcaggcgcagccaaccacgcggggcagcgtgttgtgggtagattgcaccgttggtcagcaacgtatcgccaaaccagcccacggcggcggtcatcacatccagttgataatcaatctgcccgtcagcgctaaatttcttatcctgaacgatcaccggaacatcatcgataccccactgttttggcagcattaatttcaggatctcgtcatcttcaatcaccaccaaaccagccagccccatcgccacctgacgtccggtcttgccgtgctgatgcggatggaaccagcaggtagcggcaggttgatcaacgttcaacgtcaccgagcgcttgccacctggcggaataattccctgcgggccgccgtccacttcacccggtacttccagcccgtgccagtgcaacgtcgtctcttccgtcagttggttatagatatcaaccgttactgctttgccgcgctgtaatttcaccgccggccccagcagattgccgttatagccccaggtagttgcggttttcccgctaaaggtggactggcctgcgccaatagttaactgaatgcgattacgggcatcggtcgtgagcaaatcagggatcggtaacgttgggcgttctgccgcaaatactgcgcggctccacagcggcaaagccgaagccacgcccagcgcgacggaatattttaagaaatcacgacgttgcatagttatttccttattcttaagcaggtgaaacaaaatcaaacgttgagcatagtccttccccttacgggaaggtcaagccgcagacacaatttaatcgacaataatggtcgtcgcctcgctcgcagtgtgctaacgtttatcttctttaagcccctggtagaagcaatgaagacgtttttcagaacagtgttattcggcagcctgatggccgtctgcgcaaacagttacgcgctcagcgagtctgaagccgaagatatggccgatttaacggcagtttttgtctttctgaagaacgattgtggttaccagaacttacctaacgggcaaattcgtcgcgcactggtctttttcgcccagcaaaaccagtgggatctcagtaattacgacaccttcgacatgaaagccctcggtgaagacagctaccgcgatctcagcggcattggcattcccgtcgctaaaaagtgcaaagccctggctcgcgattccttaagcctgcttgcctacgtcaaataatccctgatacctttttgtagaaatattgaccgtgcatccgcggtcaatgttagctattatgttgcgccctttttttacgggtgttaacaaaggaggtatcaacccatggccgaaaaaaaacagtggcatgaaacgctacacgaccagtttgggcagtactttgcggtagataacgttctgtatcatgaaaagaccgatcaccaggatctgatcatttttgagaacgccgcatttggccgcgtaatggcgctggatggcgtagtacaaaccaccgagcgcgacgagtttatctatcatgagatgatgacccatgttccgctactggcccacggtcacgcgaaacatgtgctgattatcggcggcggcgacggtgccatgctgcgtgaagtaacccgacataaaaacgttgagtcaatcacgatggtggaaatcgatgcgggtgtcgtgtcgttctgccgtcagtatctacccaaccataacgccggtagctacgacgatccgcgctttaaactggtgatcgacgatggcgtcaatttcgttaatcaaaccagccagacctttgatgtcattatctccgactgcaccgatcctatcggtcccggcgaaagtctgttcacctcagcattttatgaaggctgcaaacgttgcctgaatcctggcggtatcttcgtcgcacaaaacggcgtctgctttttacagcaggaagaggctatcgacagtcatcgcaaactcagccattacttcagcgacgttggcttttatcaggcggcgatcccgacctattacggcggcatcatgacctttgcatgggcgacagataacgacgccttacgccatctctcaaccgaaattattcaggcgcgttttctcgcttctggcctgaaatgccgttattacaatccggcagtccatacggcagcttttgccttaccccagtatctgcaagacgcactggcttcacagccgtcctaaggagaagataagaaattgaaaaaactgaaactgcatggctttaataatctgaccaaaagtctgagtttttgtatttacgatatctgctacgccaaaactgccgaagaacgcgacggttatattgcttatatcgatgaactctataatgccaaccgtctgaccgaaatcctgtcagaaacctgttccattatcggggccaatattcttaacatcgcccgccaggattacgaaccacagggtgccagcgtcactattctggtgagtgaagaaccggtcgatccgaaacttatcgacaaaacagaacaccccggaccactgccagaaacggtcgttgcccatctcgataaaagtcatatttgcgtacatacctacccggaaagtcatcctgaaggtggtttatgtaccttccgcgccgatattgaagtctctacctgcggcgtgatttctccgctgaaggcgctgaattacctgatccaccagcttgagtccgatatcgtaaccattgattatcgcgtgcgcggttttactcgcgacattaacggtatgaagcactttatcgaccatgagattaattcgattcagaactttatgtctgacgatatgaaggcgctgtatgacatggtggatgtaaacgtctatcaggaaaatatcttccataccaagatgttgcttaaagagttcgaccttaagcactacatgttccacaccaaaccggaagatttaaccgacagcgagcgccaggaaattaccgctgcgctgtggaaagaaatgcgcgagatttattacgggcgcaatatgccagctgtttaacggctctggcggagctcccaggctccgccagatttatttacttctgctgcacgaaattgcggtaagccgccacgacctgcagaaaatcctcaacgccgcatagcgacaggctttcttcgtcgtagtagttcatcccctcttccatttcatcgccagcgaattccagttgattggcgcgaaccatcacctcttcaccgtccatccacagggtgtattcatgccctgcccgttgccaggaccgttcgctacctttcagtgcgtgcgctgcttgttccacttcatcaagcaaggccaggttttctttcacctcttcattaaaccagtgcccgaccacttcatgccccatggacatacgcacctttaccactccggtaatatcacgcagaaattcgtaatccatagtgtgttcctctgctcccggcaatgcgccattactgcattgcaccttaggtttaattatcgcagcactatgcaagattaaaaggtggaaaagaataaggaataaaaataaaccccctttccttgagcagaaagggggtttaaagaagtgttacttgtcaggtattcaggagaacacctgagctattttcaggctgttacaccgcagtctggaaaatcaccccgtccgctttttcggtgtactgagaaagctggttgaagttcaggtaacggtaagtatcaacggcagttttatccacctgtgccacgtaggtctggtactcttccggcgtcggtagtttgccaatcagcgccgcaacagcagccagttccgcagaagccaggaagacattcgcgccagtacccagacggttcgggaagttacgggtagaggtggaaaccaccgtcgcaccgtctgctacacgcgcctggttacccatacacagggaacagccagggatctcgatacgcgcaccgctcttaccgaagacgctgtagtagccttcttcggtcaactgcgcggcgtccatacgggttggcggtgccacccacaggcgggtcggcaactggcctttatgcgcatccagcagtttacccgcagcacggaagtgaccgatgttggtcatgcaggaaccgataaacacttcgtcgatcttctcaccctgtaccgcagacagcggacgtgcgtcatccggatcgttcggagcacacaggattggctctttaatatccgccagatcgatgtcgatcactgccgcgtattccgcatctgcatcggcttccagcagctcaggattcgccagccatttttccatgccctgaatacgacgttccagggtacgacgatcgccgtaaccttccgcgatcatccacttcagcaggacgatgttggagttcaggtattcgatgatcggttctttgttcagcttgatagtacaaccagcggcagaacgctcggcggacgcatcggtcagctcaaaggcctgctcaactttcagatccggcagaccttcaatttccagaatgcgaccagagaagatgtttttcttgcctttcttctcaacggtcagcagaccttgtttgatcgcatacagcggaatagcgtgtaccagatcgcgcagggtgatgcccggctgcattttgcctttgaagcgcaccagaacggattccggcatatccagcggcattacgcctgttgcggctgcaaatgccaccagaccagaacccgccgggaaagaaatgccgatcgggaaacgggtatgggagtcaccaccggtaccgacggtatccggcagcagcatacggttcagccaggagtggattacgccgtcacccggacgcagcgacacaccaccacggttcataatgaagtccggcagcgtgtggtgcgtgttcacgtcaactggcttcggatacgccgcggtgtggcagaaagactgcatcaccaggtcagccgagaagcccaggcacgccaggtctttcagttcatcacgggtcatcgggccggtggtgtcctgggaacctacagaagtcattttcggttcgcagtacgcgcccggacgaatgcctttcacgccgcaggcacgacctaccattttctgcgccagcgagaagccgcggtcgctctcagcgacatctttcgcctgacggaacacatcgctgtgcggcagaccaagtgcttcacgcgctttggtggtcaggccacgcccgataatcagcggaatacgaccaccggcacgcacttcatcaatcagcacgtcggttttcagttcgaaggtcgccagcagttcgccggtttcgtggttacgcacttcacctttgtacgggtaaacgtcaattacgtcacccatgttcaggttagagacgtccacttcaattggcagtgcacccgcatcttccatcgtgttaaagaagatgggtgcaattttaccgccgaggcacaaaccaccgccgcgtttgttcggcacatgtggaatatcatcgcccataaaccacagaacggagttcgtggcggatttacgcgatgaacccgtacccacaacgtcaccgacgtacgccagcgggaaacctttctgttgcagagcttcaatctgtttgatcggaccaacaacaccaggctgatctggctcaataccttcacgggcgtttttcagcatcgccagcgcgtgcagtgggatatccgggcgtgaccacgcatccggtgccggagaaaggtcatcggtgttggtttcgcctgtgactttgaagacggtaacggtcagtttttcagccagtgccgggcgattcaggaaccattcggcatccgcccaggactgcattacctgcttcgcatattcgttgcctgctttggctttctcttctacgtcatagaagttatcgaacatcagcagcgtgtgagaaagtgctttggcagcgatcggtgccagtttggcatcatccagcgcgtcgatcagcggatgaatgttgtaaccaccctgcatagtgcccagcagttcgatggctttttccggagtcagcagtggggatttggcttcgcctttcgcgacagcagccaggaagcctgctttgacataggcggcttcatcgacgccagggggaacacggttggttaacagatctaacaggaattcttcttcgcccgcgggcgggtttttcagcagctctacaagtgcggccatttggtttgcatccaggggtttgggcgcaatcccctcagcggcacgctcagctacgtgcttacggtattcttctagcacgacggttctcctcgctctcattgtcatagtgcggcaggcgattctcttcacgctcctgtgagacagcagtttgtagggtaaatgcccagtaccgcaacgggcagaatagcaggattttgacgatgtgttaatctgtttacaaaaaagcaacataaaaaagtggctgaatcgttaaggatggtctagagattgtttccctccgtaaaaacttcgttaattcgcatggtgataatcacctttctcaacgaatcccaagattagtcaaaatttaaactaccgcctctttatactcggattctcagcacctgcgggtggcagttcgccgaccattgcgatttccttgagatccgaattatgaaaatgactttgccgtttaaaccccatgtgctggcgctaatttgcagtgccgggctttgtgccgcctctgccgggctatatataaaaagccgcacagtggaagcgcctgtggaagcgcaatcgacacaacagaatgcgcctgacatctccgcagttacgcttcctgcaacggtttccgcacctcccgtaacacccgccgtcgtcaaatctgcattcagcactgcacaaatagatcaatgggtcgcgcccgtcgcgctgtatcccgacgccctactttcgcaggtgctgatggcatcaacctatccgacaaacgttgctcaagcagtgcaatggtcgcacgataatccacttaaacaaggcgatgctgctattcaggcggtatctgaccagccctgggacgccagcgtcaaatcactggtggcctttccacagttgatggcattgatgggcgaaaacccgcaatgggtgcaaaacctgggcgatgcttttctggcgcagccgcaggacgtgatggactcggtacagcgattgcggcaactggcgcaacaaaccggctcgctgaagtcatcaactgaacaaaagatcatcacgacaacgaaaaaagtcgtaccggtaaatcagcccgccaacgcccctgtcacacaatcaaataccgtttctacgtccagccccgtcgtcgcagaacctgcaccgaccgtaataaccattgagccagccaatccggatgtggtttatattccgaactacaacccaaacgtggtttacggcagttgggccaataccgcttatccgccagtttatctgccaccaccagccggagaaccgtttgttgacagctttgtgcgcggattcggctatagcatgggcgttgctaccacgtacgcgctattcagcagcatcgactgggatgacgacgatcatgaccatcatcatcatgacgatgatgattatcaccaccacgatggcggtcatcgtgacggtaatggctggcaacacaacggcgacaacatcaatatcgacgtaaacaatttcaaccgtatcaccggtgagcatcttactgataacaatatggcatggcggcacaatccaaactaccgtgatggtgtgccctatcatgatcaggatatggcaaagcggtttcaccaaaccgatgtcaacggcggcatgagcgccacgcagttacctgctctatcgcgcgacagtcagcgtcaggcagcagcaagtcagtttcagcaacgaacacacactgcgccagtcattacgcgagatactcaacgtcaggctgcggcacagcgatttaatgaagcggaacattatgggagctatgacgacttccgcgagttcagccgtcgccaaccactgacccagcaacaaaaggacgccgctcgtcagcgttatcagtcggcctctcctgagcagcgccaggcagtccgcgagaaaatgcagactaacccgcagatccagcagcgaagagaggcagcgcgtgagcgtattcagtccgcctcgcctgagcagcgccaggcggttcgcgagaaaatgcagactaacccgcagaaccagcagcgaaaagaggcagcgcgtgagcgtattcagtccgcatcaccagagcagcgccaggtgtttaaggaaaaagtacagcagcgcccactgaaccaacagcaacgtgataacgcccgccagcgtgttcaatcagcatcacctgagcaacgtcaggtttttcggaagaaagttcaggagagccgcccgcaacgtctaaacgacagtaaccgtactgccaggctgaataacgagcaacggtcagcgatacgggaacggttgtctgagcgtggagcaaggagaatggaaaggtaaaatgcaggcgtaaaaaaagcggcgtggttagccgcttttttaattgccggatgttccggcaaacgaaaaattacttcttcttcgctttcgggttcggcaggtcggtaatgctaccttcgaacacttctgccgccaggcccacagactcgtgcagagtcgggtgcgcatggatggtcagtgcgatgtcttcagcatcacaacccatttcgattgccaggccgatttcacccagcagctcgccgccgttagtaccgacaatcgcaccaccgatcacacggtgagattctttgtcgaaaatcagcttggtcataccgtctgcgcagtcggaagcgatcgcacgaccagaagcagcccacgggaaggtggcagtttcatagctgatgcctttctctttcgcttctttctcggtcagacccacccatgcaacttctggttcggtataggcgatggacgggataactttcggatcgaagtagtgtttcttaccggcgataacttcagcggcaacgtgaccttcgtgaacacctttgtgtgccagcatcggctgaccgacaatatcgccgatagcaaagatgtgcggtacgttagtgcgcagctgtttgtcaacgcggatgaaaccacggtcgtccacttccacgccagctttgcctgcgtcgaggtttttaccgttcggcacacgaccaatcgctaccagcacggcgtcgtaacgctgcggttcagcgggtgcttttttgccttccatcgtcacataaataccgtcttctttcgcttcaacggcggtaactttggtttccagcatcaggttgaatttcttgctgatacgcttggtgaagactttaacgatgtctttgtcagctgccgggataacctggtcgaacatttcaaccacgtcaatctgtgaacccagcgcgtggtatacggtccccatttccagaccgatgataccgccacccattaccagcaggcgttctggtacttctttcagttccagcgcgtcagtggagtcccagatacgcggatcttcatgcggaataaacggcagttggatcgggcgagaacccgctgcaatgatcgcgttgtcgaagttgatcacggttttgccgttctcaccttcaacttccagggtgttagccccggtaaatttacccagaccgttgaccactttgactttgcggcctttcgccataccagccagaccaccggtcagctgattgatcactttctctttccaggtacgaatcttgtcaatatcggttttcggttcgccgaagacgataccgtgttcagcaagcgctttggcttcttcgataacttttgctacgtgcagcagtgctttagaagggatacagccgacgttcaggcaaacaccgccaagggtgttgtaacgttctacgattacggtttccagacctaaatcagcgcaacggaaggcagcggagtaacctgcggggcctgccccaagtaccacgacctgagttttgatttcagtactcatcatgacctctatatatttatctccggcgggtctgacgttttttttatgacgcccattatccaccgggtcgttctatccgtcggtattttacaaaattgttaacaatttttaaacaacaaacggcaaccgatttgtctattcgctaataacctcaatacattcatgagattaccagaaaaaagccggccgttgggccggctcttttacttacatcaccagacggcgaatgtcagacagcgtgttgttaatgatggtaatgaaacgggcaccatcagcaccgtcgatcacgcggtggtcgaaggagagagaaatcggcagcatcagacgcggcacgaactctttaccattccacaccggctccatcgcggacttggaaacgccgaggatagccacttccggcgcgttcacaatcggcgcgaagtgggtagtacccaggccgccgatgctggagatggtgaagcaaccgccctgcatttcgcccgcagtcagcttaccgtcacgcgctttcttagaaatagtcatcagctcgcgagacagctcgatgatgcctttcttgttgacgtctttgaataccggaacaaccagaccgttcggggtatccaccgccacaccgatgttgatgtatttcttcagggtcagacgctgaccgtcttccgacagcgaactgttgaagcgaggcatctgctcaagagctgcagcaaccgctttcatgatgaagacaactggggttatcttcacatccagcttacgtttcgccgcttcttcgttctgctgtttacggaacgcttccagctcggtgatatcggttttgtcgaagtgagtaacatgcgggatcatcacccagttacggctcaggttcgcaccagaaattttctggatacggcccagttccacttcttcgatttcaccaaacttgctgaagtccaccttcggccacggcagcatgcctgggataccgccgccagtcgccgccggagccgcttctgcacgtttgatagcttctttcacgtaagcctgaacgtcttcgcgcaggatacgacctttacggccagtgcccttcactttcgccaggttaacgccaaactcgcgtgccagacggcggatcagcggagtcgcgtgaacgtaagcgtcgttttcagcaaattcagatttgccttccgctttcgcagccggtgctgctgccggagcttcagcttttgctgccggagccggcgctgccgcttcctgtttcgcaggagctgccgcaggcgctgcgccttcaacttcgaagatcataatcagcgagccagttttcactttatcgccaacgttgactttcagttccttcacgacgcctgcaaacggagccgggacttccatagaagctttatcgccttctacggtgatcagtgactgttcagcggcaactttgtcgcccactttcaccatcacttcggtcacttcaacttcgtcaccgccgatatccggaacgttaacttctttcacgccagctgctgatgcaggggccgctgccggagctgcttcctgtttagccgccggagctgccgcgcctgcttcacccgcgacttcgaagaccataatcagcgagccggtagacactttgtcacccacgttcactttgatctctttcacggtgcctgcaaacggagccggaacttccatagaagccttgtcgccttctacggtgatcagcgactgttcagcttcaactttatcgccaactttcaccaggatttcggtcacttcgacttcgtcgctgccgatatccggaacgttaacgtcttttgccgccgcagccgctggtgctgctgccggagctgcttctttcttctcttctgcctgagcaggtgcagcgtcagctgcaccgtcggcggaatcgaaaatcataatcagtgcgccggtctgggttttatcgccaacagagactttgatctctttaacgatacccgcctgcggagatggtacttccatagaggctttgtcgccttctacggtgatcagcgactgttcggcttcaactttgtcgcccactttgaccaggatctcggtgatttcaacttcatcagccccgatgtccggtactttgatttcgatagccattattcttttacctcttaagccagacgcgggttaactttatctgcatcgatgttgaatttggcgattgcgtcagcaaccactttcttatcgatttcgccacgtttagccagttcgcccagcgccgcaaccacgacataagaagcatcaacttcgaagtggtgacgcaggttctcacggctgtcggaacgaccgaagccatcagtacccagtacgcgatagtcgtcagccggtacgtaagtacggacctgctcagcgaacagtttcatatagtcggtagatgccactgccggagcgtcattcatcacctgagcgatatacggaacgcgcggtgtttccagcgggtgcagcatgttccagcgttcacaatcctgaccatcacgcgccagctcggtgaaggaggtcacgctataaacgtcagaacctacgccgtaatctttcgccaggatctctgccgcttcacggacgtgacgcaggatagaaccggagcccagcagctgaactttacctttgctaccttcaatggtttcgagtttgtagatacctttacggataccttcctcagcaccttccggcattgccggcatgtggtagttttcgttcagcgtagtgatgtagtagtaaacgttctcttgtttttcaccgtacatacgctccagaccgtcatgcatgatgacagcaacttcgtaagcgtaagccgggtcgtaagagatacagttcgggatagtcagcgactgaatgtggctgtgaccatcttcgtgctgcagaccttcgccgttcagggtggtacgaccggaagtaccgccgatcaggaagccacgcgcttgctggtcgccagccgcccagcacagatcgccgatacgctggaagccgaacatcgagtaatagatgtagaacggaatcatcggcagattgttggtgctgtaagaggtcgccgctgccagccaggaacaccctgcgcccagctcgttgatcccttcctgcagaatctgacctttctcgtcttctttatagtaagcaacctgctcgcggtcctgcggggtgtactgctgaccgttcgggctgtaaataccaatctgacggaacagaccttccataccgaaagtacgcgcttcgtcggcgatgatcggtaccagacgatctttgatcgacttgttcttcagcatcacgttcagagcacgaacgaaagcgatagtggtagagatctctttgctctgctcttccagcagcgcgccgaagtcttgcaggctcggcagctcaagcttctcggtgaagttcggctgacggcttggcagataaccgtgcagtttctgacgctgagcgtgcagataggtatgctcttcagaaccttccgggaaggtgatgtacggcagtttttcgatatctgcatcagacaccggcacattgaaacggtcgcggatatgacgcacgccgtccatgttcattttcttaacctggtgcgcgatgtttttaccttcagccgcgtcgcccatgccgtaacctttaatggtatgagcaaggattaccgtcgctttgcctttggtttcctgcgctttcttgaatgcagcgtagattttcttcggatcgtgaccgccacggttcagcgcccagatctgctcgtcagtccagtctgcaaccagagctgcggtttccggatatttaccgaagaagtgttcacgaacgtacgcaccatctttcgatttgaaggtctggtagtcgccgtcaacggtttcgttcatcagctggatcagtttaccgctggtatctttacgcagcagttcatcccaacggctaccccacatcactttgatcacgttccagccagcaccttcgaagatgccttccagttcgttgatgatcttgccgttaccggtgaccgggccgtcaagacgctgcaggttacagttgataacgaagaccaggttatccagtttttcacgggtagcgatggtgatcgcacctttggattccggttcgtccatttcaccgtcgccgaggaaggcgtaaacggtctgtttagaggtatctttcaggccacggtgttccaaatatttcaggaatttagcctggtaaatagcaccaatcggacccagacccatagatacggtcgggaactgccagaattccggcatcagtttcgggtgcggataggaagagaggccattgccgtgaacttcctgacggaagttatccagctgctcctgagtcagacgaccttccaggaaagcacgagcgtaaacgcccggggagatgtggccctggaagtaaaccagatcgccgccatcctgctcgttgcgtgcacggaagaagtggttaaagcacacatcataaatggttgcggaagactggaaggacgccatgtggccgcccagttcgaggtcttttttcgacgcacgcagaaccgtcatgatggcgttccagcggatagctgaacgaatacggcgttccagttccagattacccggatactccggttgttcttcaacggggatggtgttgatgtagttgctgataccggtgcctgcggctacgttgacaccgcctttgcgggcttcagcaagcagttggtcgatcagatactgagcacgctcaacaccttcttcacggatgaccgattcgatcgcctggagccagtcgcgagtttcgatcggatccacgtcatttgggaaacgttctgacatgggttattccttatctatctaataacgttgagttttctggaacctgtcccattgaactctcgccggaaagctcaataagacaggttctacgtttagttgccgcgcttttatatgcgcttgatttacaacatcttctggataatttttaccagaaaaatcactaattctttcgttgctccagacgacgcagagaacgctcacggcgactctcttcgcggcttctgtcgagcaaaatttcttcgataaaggccagatggcgatgcgatgcttcgcgcgcttcttccggcttaccggccataatcgcttcaaatatgcgggtgcggtgactactcaccagcggcagcatctcgcgacgcgaatagagcaattcgaagttctggcggacattctgggccaacatcggctccatacaccttagcagatgaagcagaaccacattgtgggccgcttcggtgacggcaatctgatactggagtacggcatttgattccgcgtccagatcgccagactgctgcgccagctctatggcgtggtggagttcacggatgcgttccttgtcttcatcggtactacgcagcgcggcgtaataagcggcgataccttccagggcgtgtcgtgtttcgagcaagtcatactgtgattcaggatggtcggagagcagctccaccagcggatcgctgaagctttgccataggctgctctggacaaaagtgccgccaccctggcgacgaagcaacaagcccttcgcttcgagacgttgaatcgcctcacgcaaggagggacgggagacgtcgaactgtttcgccagttcgcgttccggtgggagtttttcgcccgggcggagtgtgccttcgaggatcaaaaactccagttgctgctcaatcacatcggagagttttggttggcggattttgctgtaggccatgagttcctgtcttaagccacttgccgaagtcaattggtcttaccaatttcatgtctgtgacgctaaagtaacaaagtattcaccttatgtccatataggttttgattgaaatcatgaaactgtgcacattttaacaacttgacatatataacgtttcaaagttgtaactatgcacaaatgtagactttacgtaggaaaggggttttttaacgattattaaactataaaaatccgaattgaaccgattcacttaccaattttgtgatttttaattcaattaaaacgaatttaaattcattatacatattgagaggggttgaggctgagctttacaaacggtttctttttaagcaactcatcttcaaccatgcataaagcgggtgcattcgctgccgcataccattattcttgatctgacggaagtccttttgtaacaattcaaacttctttgatgtaaacaaatcaatacaacaaacggaattgaaaacttacacacgcatcactgcgtagatcaaaaaaacaatcaccgcacgaggtttcatgatggaaggtcaacagcacggcgagcagctaaagcgcggccttaaaaaccgccacatacagcttatcgcgctgggaggcgcgatagggacagggctattcctgggtagcgcctccgtaatacagtccgcagggccagggattatcctgggttacgccattgctggttttatcgcctttctgatcatgcgtcagctaggtgaaatggtggtcgaggaacctgtcgcaggctcctttagccactttgcttataaatactggggcagttttgccggtttcgcctctggctggaactactgggtactgtacgttttagttgccatggctgagctgactgccgtgggtaaatacattcagttctggtatccggaaatccccacctgggtttctgccgccgtgttctttgtggtgatcaacgccatcaacctgacaaacgtaaaagtgtttggcgagatggagttctggtttgccattatcaaagttatcgcggtggtagcgatgatcatcttcggcggctggctgctattcagcggcaacggcggcccgcaggcgagcgttagcaacctgtgggatcagggtggtttcctgccgcacggcttcaccgggctggtgatgatgatggcgattatcatgttctctttcggtggtctggaactggtgggcatcaccgcagcagaagcagataacccggagcaaagtattccaaaagcgactaaccaggttatctaccgcatcctgattttctatattggttcgttagccgttctgctctcgctgatgccgtggacccgcgttactgctgataccagtccgtttgtactgatcttccacgaattgggcgatacctttgtggctaatgcgctgaacatcgtggtactgactgctgcgctctccgtgtacaacagctgcgtatattgcaacagccgtatgctgtttggtctggcacaacagggcaacgcgccaaaagcgctggcgtctgtcgacaaacgcggtgtaccggttaacactattctggtgtctgcgctggttacggcattgtgcgtactgattaactatcttgctccggaatccgcatttggcctgttaatggcgctggtggtatctgcactggtaatcaactgggcgatgattagcctggcgcatatgaaattccgtcgcgccaagcaggaacaaggcgtggtaactcgcttccctgctctgctttatccgctgggtaactggatctgcctgctgtttatggcggcggtactggtgattatgctgatgaccccaggaatggcgatttcggtatacctgatcccggtatggctgatcgtgttaggtatcggctatctgtttaaagagaaaaccgccaaagccgtaaaagcgcattaatctctctacgccctcacccgtgcagggtgagggcaataatctttacaccaacgccccgtaaatcgtcagtagcgcaattaccaccacgaccacgaacgaggttttcttcgccatggaaaccgctgccttcggcgtctccaccttatcgacatgcggttcacgcgccagagagaactgtgccagacgcgttaatacctgatattgcgaagtatggaaatcacccagcgaagcaaaccaggccggtaacgctttctcaccatgaccgatcaaggcatataccacacccgcaagacgaaccggcacccaatccagtacatgaagcacggcatcaatgccggactgtaaacgatgatgcggcgtctggtaacgcgccagccagtattgccatgcacgcaaaaacgcataccccatcagcgtaacgggtccccaggttccccccacaatcagccagaacagcggtgcaagataaaaacgaaagttaatccacagcaatgcattttgcagctcacgcaaatactcacgttcatcgcagcctgccgggacgccgtgaatcatggtgagttcgccagccatcgtggcacgggcatggctatcattacgtgaagcagctgtcagataagcatgataatgaagacgaactttacctgcgccaatacacagcaaaccaatcagcagccacaccagcagcgtgggaacgttgaacaatactccctgcaatgcgcgtaacagtaaaaaagtcacgcccatcgcaataatggtcatgcctaatgtgcgcccgagagaaaaatgtttcacccgccgaaagaacgcttcaagacgatgatcaagctgccagtgctcgcccaacttaaacaggcgctcgaaaattaacaccagtaaggttgtaaatagcgtcatgttgtctccttgctgaccagtgcacgaaaccgtgcccaatcaaatgcaggaccgggatcggttttccgatccggcgcgatatcacaatggcccgtcatgttattagcgatatctggatagcgatcaatcagtgcccgcgtaaccgccgcaagctgttgatactgcgcatcggtatacgccagcgtatcggtgccttccagctcaatcccaatagaaaaatcattgcagcgttcgcgcccctgatactgagagactccggcatgccaggcacgtttatcgaaaggaacatactggactatttcaccatcgcggcgaatcaaacagtgagcggagacgcgcaaatgggcgatctcagcaaagaaaggatgtgcctgcggatcaatagttccagtgaataatgcgtcgatccacggaccgccaaactcgcctggcggcaggctaatattgtgcaccaccagcagggtgggtgtttcgtcatccgggcggcaatcgtaatgtggtgagggaacgcggcgcgcgccaaccagccacccctgttctaacaacatgcaggatctccttatatgtggtgctaatacccggttcagagtagcatgtttctaccttatgattcgttagctatctggagttttaacatgccgcctcgccgctataaccctgacacccgacgtgacgagctgctggaacgcattaatctcgatatccccggcgcggtggcccaggcgctgcgggaagatttaggcggaacagtcgatgccaacaatgacattacggcaaaacttttaccggaaaactctcgctctcatgccacagtgatcacccgcgagaatggcgtattttgcggcaaacgctgggttgaagaggtgtttattcaactggcaggcgacgatgtcaccataatctggcatgtggatgacggcgatgtcatcaacgccaatcaacccttgttcgaacttgaaggcccatcccgcgtgctgttaacgggcgaacgcactgcgcttaattttgtgcaaaccctttcaggggttgccagtaaggtacgccactatgtcgaattactggagggcaccaacacgcagttgttggatacgcgcaaaaccttacccggcctgcgttcagctctgaaatacgcggtactttgcggcggcggagcgaatcaccgtctggggctttctgatgcctttctgatcaaagaaaaccatattattgcctccggctcagtgcgccaggcggtcgaaaaagcatcctggctgcacccggatgcgccagtagaagtcgaagtagagaatctggaagaacttgatgaagccctgaaagcaggtgccgatatcatcatgctggataacttcgaaacagaacagatgcgcgaagccgtcaaacgcaccaacggcaaggcgctactggaagtgtctggcaacgtcactgacaaaacactgcgcgaatttgccgaaacgggcgtggactttatctccgtcggtgcgctaactaaacacgtacaggcactcgacctatcaatgcgtttttgctgattgctgacagatttatccgctccatcgcgggcggataatctcccctttcccaactttcttcgtaacgcctcgcaaatttcttgtctttcgctgcaacataataaaaaactccggaagctgctttcccgtttcgttttttgcccctcgcttgtgctgatggcgtttgccaaagtagcgccaaccaaatcaaggagcgaaacaaatggacaagcaacgcggttttacacttatcgaactgatggtggttattggcatcattgccattttaagcgccattggtattcccgcttatcaaaactacctgcgcaaagccgcactcaccgacatgctacaaacctttgtgccttaccgtaccgccgtagagttgtgcgcgctggaacatggtggattagatacctgcgacggtggcagtaatggcatcccctcgcctaccaccacccgctatgtttcagccatgagtgtggcaaagggcgtggtgtcgctgaccgggcaagaaagtctcaatgggctaagcgtcgtcatgacgccgggttgggataacgcaaacggcgtcaccggttggacgcgcaactgcaatattcaaagtgacagcgcattgcagcaagcctgcgaagatgtcttccgctttgatgacgccaactaaggagcggcaatgaatattccacagctcaccgccctgtgtctgcgttatcagggagtcttgctggatgccagcgaagaggtggttcatgttgcggtggtcgatgccccttcgcatgagctactagacgcattgcatttcgctaccaccaaacgtattgagatcacctgctggacgcgccaacaaatggaaggtcacgccagtcgcacacaacagacattgcccgtagctattcatgagaagcatcagcccaaagcagagttgctgactcgaacgctacaatctgcgctggaacaacgcgcgtctgatattcatatcgaaccagcggacaatgcctaccgcatccgcttgcgtatcgacggcgtattgcatcctttaccggatgtttcaccggatgtcggagtcgcattaaccgccagattaaaagtgctgggcaacctggatattgcggaacatcgcctgccgcaggacgggcaattcactgtcgaactggcaggaaacgccgtctcatttcgtattgcgaccttaccatgtcggggtggtgaaaaggtggtattaaggttgttacagcaggtgagtcaggcactggatgtcaacacgcttggaatgcagccgttacaactggcggactttgctcatgccttgcaacaaccacagggactggtgctggtaacaggccctacaggcagcggcaaaacggtcacgctttatagtgccctgcaaacgctgaataccgctgacattaatatttgtagcgtcgaagatccggttgagatccccatagccggactaaaccagacgcaaatccatccgcgtgccggactcacctttcagggcgttttgcgtgcgttattgcgccaggaccctgacgtcattatgatcggagagatccgcgatggcgaaacagcagagatcgctattaaagcggcgcaaaccggtcacctggtgttgtctaccctacacaccaattccaccactgaaacgctggtacgtttacagcaaatgggagtcgcccgctggatgctctcatcagcgcttacactggtaatagcccagcgtctggtacgcaaactttgcccacattgtcgcctgcagcaaggggagtccatccatattccagacaatgtatggtcgtcgccgctgccccgctggcaagcacccggttgtgtacattgctaccacggtttttatggtcgtacggccttatttgaagttctacccataacaccggtcatacgccagcttatttccgctaataccgacgttgaatcgctggaaacgcacgcccgacaggcgggtatgcgtacgctttttgaaaacggctgcctggccgtggagcaaggcttaaccacctttgaagagttaatccgcgtattggggatgccgcatggcgagtaagcaactctggcgctggcgtggcataaccggcgacggcaatgcgcaagatgggatgctatgggcagagagccgtgctttgctgcttatggcactacagcaacagatggttaccccactaagcctgaagcgaatcgccatcaattctgcgcagtggcgaggagataaaagcgcggaagtcattcatcaactggcgacgctactcaaagccgggttaacgctttctgaagggctggcactgctggcggaacagcatcccagtaagcaatggcaagcgttgctgcaatcgctggcgcacgatctcgaacagggcattgctttttccaatgccttattaccctggtcagaggtatttccgccgctctatcaggcgatgatccgcacgggtgaactgaccggtaagctggatgaatgctgctttgaactggcgcgtcagcaaaaagcccagcgtcagttgaccgacaaagtgaaatcagcgttgcgttatcccatcatcattttagcgatggcaatcatggtggttgtggcaatgctgcattttgtgctgccggagtttgctgctatttataagaccttcaacaccccactaccggtactaacgcaggggatcatgacgctggcagactttagtggcgaatggggctggctgctggtgttattcggctttctgctggcgatagccaataagttgctgatgcgccgcccgacctggcttatcgcgcggcagaaattgctgttacgcatcccgattatgggttcactgatgcggggacaaaaactcacgcagatctttacgattctggcgctgactcaaagtgcaggcattacttttttacagggcgtagagagcgtcagagaaacaatgcgctgcccgtactgggtgcaacttctgacacaaatccagcacgatatcagtaacggtcaacccatctggctggcgctaaaaaatgccggtgagtttagcccactctgtttgcaattagtgagaacaggagaggcatccggctcgctggatctcatgttagacaacctcgcccatcatcatcgggataacacaatggcgctggcggataacctcgcagccttactggaaccggcgttgctgatcataacgggaggaattatcggtacgctggtggtggcaatgtatctgcccattttccatttaggcgatgcgatgagtggaatgggataacgctggcgtgttgctccacgccagcgttgggagattacaggttgttgaagatgcggttttcttgttccagcacacggataaatgtggtgcgcttggtcagctctttcaggcgtgaagccccaacgtatgtacaagctgaacgcaggccgcccaaaatatcacgcgcggtattttcaaccgggcctcgcagcggcagcttaacggttttaccttctgctgcgcggtattccgcaacgccgccaacgtgacgtttcatcgcagactcggagctcatgccgtagaacagcataaatttctcgccgttctcctcaacgatgcgaccgccgctctcttcgtggcccgccagcatgccgccaagcatgacgaaatcggcaccgccgccaaaggctttcgcgacatcgcccggcgtggtgcagccaccgtcgctgacgatcattccgcccagaccgtgcgcagcatcggcacattcgatcaccgcagaaagttgcggataaccgacgcctgttttgacgcgagttgtacaaacagaacctgggccaatgccaactttaacgatatcagcaccggagaggataagctcctcacacatttcaccagtcactacgttgccagcacaaatggttttggtcggccacgcttcacgcgctttcgcaacgaactgcacgaagtgttcggaataaccattcgccacatcaatacaaacgaagtttaatgccgggttcaggtcgagaatctgtttagttttttcgaaatccgcatcagacgtgccagtagaaaccatcacatgtttcagcacatcagcggaagaattgttgataaacgcttgccactcttcgacagaatagtgtttatgcacagcagtcaaaatatcaaaagaagccagcgcagaggccatagaaaatgtgcctacggtgtccatatttgcggctataatcggcacgccggaccagctctgacctgaatgtttgaaggtgaattgacgttccagttcaacatcggaacggcttttaagagtggagcgtttagggcggatgagaacgtctttaaaacctaacttcagatcttcttcaatacgcatgtgcggattcctggggttaatggctataagggtaagagcgcaactccagtgacgctatcatacgcactaatcaatgcggcgcaagactgcgaaattgtctttttttacgctacaatcccataaatttacctggtaaatagtgagcgaacgtttcatcaatttcgctttcgtgcgctcatttttaacgttttgataatcatgatgaattcccgggaatataaattatgaggtatatagttgccttaacgggaggcattggcagtggcaagagtaccgttgccaatgcgtttgctgatctcggaattaacgtcattgatgccgatattattgcgcgtcaggtggttgaaccaggtgcacctgcgctacatgccattgctgatcactttggcgctaacatgattgctgctgatggaacattgcagcgccgggccttgcgcgagcggatcttcgccaacccggaagagaaaaactggcttaacgccctgctgcatccgctgattcagcaagagacgcaacaccagatccagcaagcaacttccccctatgtactgtgggttgtgccattgctggtagaaaactcactgtataaaaaagcgaatcgagtgctggtggtggatgccagcccagaaacgcaacttaagcgcaccatgcagcgcgatgatgtaactcgcgagcatgtcgaacaaatccttgctgctcaggcaccgcgcgaagctcgccttgccgtggcagatgacgtcattgataataacggcgcaccggatgctatcgcatcggatgttgcccgcctgcacgcacactatttgcagcttgcgtcgcagtttgtctcacaggaaaaaccgtaatgcagacccaggtcctttttgaacatccactaaatgaaaaaatgcgtacgtggctgcgcattgagtttttgattcagcaactcaccgttaatttacccatcgctgaccacgctggcgcactgcatttcttccgtaatgtcagtgaattactggatgttttcgagcgtggcgaagtccgcactgagctgttgaaagaacttgaccggcagcaacgtaaactccagacctggattggcgtgcctggcgtggaccagagccgtattgaagcattaattcagcagttaaaagcggcggggagcgtattaatttccgcgccgcgtatcgggcaatttctgcgtgaagatcgtttgattgctctggtgcgtcagcgactgagcatcccaggcggctgttgcagctttgatttaccttcattgcacatttggctgcatctaccccaggcgcagcgcgacagccaggtagaaacctggattgccagcctgaacccgctcacccaggcacttaccatggtgctggatttaattcgccagtcggcccccttccgtaaacaaaccagcctgaatggtttttatcaggataacggtggcgatgccgacttgctgcgcctgaatctgtcgctcgattcacagctttatccgcaaatttccggtcataagagccgttttgccattcgttttatgccgctggacagtgaaaacggacaggtaccggaacgtctggatttcgaattggcctgttgctaaggagtaaaaatgtcagaaactattacggtgaattgcccaacctgcgggaaaacggtggtatggggtgaaatcagcccgtttcggccattttgctccaaacgttgtcagctgatcgacctcggagaatgggctgctgaagaaaaacgaatccccagcagtggcgatctttccgaaagcgatgactggagcgaagagccaaagcagtgacattttgtctgatgcgacgctggcctgataagacgcgccagcgtcgcatcgggcatcttgtgcaaatgttggatgcggcataaacacctatccgacatacacacgcttaagcttcgcaattaccggttcattggctggcggaaaatcatcggcaatcagaccgaccagcgacatccactcaccgggttgcccttctttaccccacggctccccttcccagctttcgaccagccagaaccacagagttatatgcctgtccgggaattcatattccagtttttcaaatagcgaaaaatgttgtggggtaatcccgacctcttcctgaagttcacgcaccaccgcctgttccggcgtttcgctcatttcaattttaccgccgggaaactccagtttattcgccatgtgcgcatctgctgcgcgacgggttataaagatttcattgttctcgttgcgaataatacctaccgcaatttgcagctttttcattgtcttaaacctataaaaaaggcgcagaatcctgcgccttttacttcaactgttagcttttattgcaggcgaccatggcactgcttgtattttttaccagaaccgcacgggcaaggatcgttacgtcctactttgcgttcaccggtttgcgccgccagtgcagctgcggctgcagagtcgtcatcctgatggctaagctgctgcatttgcgctaaacgctcggcttccatacgacgctgttgttccagctcctcaacctcttcaggcatacgtacctgaactttgctcagcgtgctgataacttcatatttcaacgactccagcatcgctgcaaacatggagaacgattcacgtttgtattcctgcttcggatctttctgtgcatagccacgcaggtggataccctgacgcagatagtccatcgctgccaggtgctctttccacagagagtcgagagtttgcagcatgacgcctttttcgaagtgacgcatcatctcagcaccaaccacttcttctttacgctgatacacttcgatggactgcgccagaatgcgctcacgcagcgtctcttcatgcagttctggttctttatccagccactcggcaattggcaaatcgaggtcgaaatcgttcttcagacgttcctgcagccccggaatatcccacatttcttccagcgactgtggcggaatgtaggcatcaatggtcgctttgaacacatcttcacgaatgctgttgatggtttcgctcacatcgctgacatccagcagttcgttacgctgggagtaaatggcgcgacgctgatcgttagccacgtcatcatattccagcagttgcttacgaatgtcgaagttacgactttcaactttacgctgggcattggcaatcgctttagtcacccacgggtgttcaatggcttcgcctggcttcatacccagtttacgcatcatgccggatactcggtcggaagcaaaaatacgcatcagcgcatcttccatcgacaggtagaaacgggaagaaccagcatccccctgacgaccagaacgaccgcgcaactggttatcgatacgacgggattcgtgacgctcggtaccgatgatatgcaggccacctgctgccagtaccgcatcgtgacgtacctgccagtcggctttaattttttcaatttgctctgcggtcggattttccagcgcggcaacttctgcctgccagctaccaccgagcacaatatctgtaccacgacccgccatgttggtcgcgatagtcaccgcagccggataacctgcctgagcaacaatcgccgcttcgttggcgtggaatttggcgttcaggacgttgtgcttaataccggctttggtcagttcgtttgataccagctccgatttttcgatggagatagtacccaccagcaccggctggcctttcgcagtacgttctttgatatcttcaatgatcgcctgaattttttccgcttcagtcatgtagaccaggtccggcagatctttacgaatcattggacggttggtcggaacaacgacggtatccagcttgtagatggagctgaattcgaaagcttcggtatcagcagtaccggtcatccccgccagtttttcatacagacggaagtagttctggaaggtgatcgacgccagcgtctggttttcgttctggatctgtacaccttctttcgcttccactgcctgatgcaggccatcggaccaacgacgtccctgcatggtacgaccggtgtgttcgtcaacgatgataacttcaccatctttaacgatgtagtcgacgtctcgggtaaacagcgcatgagcgcgcagcgccgccgttacgtggtgcatcagcatgatgttggccggagagtacagagactccccttcatccatgatgccttctttcaccagcagttcttcaatcagcaccagaccacgttcggtcaggttcacctggcgagatttttcgtccaccgagaagtggccttcgccctggaaggtttcggagtcttctttttcctgacggatcaggtgcggaataattttattcacgcgtttatacatttccgagctgtcttctgccgggccggaaatgatcagcggtgtacgagcttcatcgatcaggatggagtccacttcgtccaccagcgcatagtgcagtttacgctgtacacgttcttcagggctgaacgccatgttatcgcgcaggtagtcaaagccgtattcgttgttcgtaccgtaagtgatgtcagctgcgtaagcttcacgcttcgccggtgctggcatgcccggcaggttgataccgacagtcaggccaaggaattcaaacagcggacggttgttttcggcgtcacgttgcgccaggtagtcgttgacggtaacaacgtgtacgcccttaccggttaatgcgttcaggtaagcaggcagcgttgcggtcagggttttaccttcaccggtacgcatttcggcgatgcagcgttcgttaagaaccataccgccgagtaactgaacgtcgaagtgacgcataccaaagacgcgcttacttgcctcacgcaccacggcgaacgcttccgggatcagattttccagcacttcgcctttttccagacgcgcacgaaactctgcggttttccctttcagttcttcgtcggagagtttttccatctccggttccatggcattgatgatgttgaccactttgcgcatccggcgcagggtgcgatcgttacgactaccgaaaactttagttaataatttgattagcataataaaatctcaaacgccccgcgttgcggagtcaataaaatgaagtaaaggtttattgttgttagctgaggcgttgagggccagcacggatgccttgcgcctggcttatccagacgggcgtgctgaattttgcttgcggggtaaaatgcgcataatcaatgcgataacccttttcagacggcgtgccttcctgggtcaacagcgcgctgagcgtatccagtaatgcaagatgttgcgcctgaagaggcaaagattcttcagcaacgggcagcgtttgcggtgccattgcgaaggaaagatgacggattaccgtgcgaatggcatgttgatgccagtaatcaacggaatagttcgaattcgggcggcgcgtgttcgcttccagcaaggccaattgaccaaagttaactttggctgaaggctcgtggttgcgggttgtcgcttttgcgggcgcgtttggttcggcggcgttgctgagcgcaggcaaacctaaactcgccgcgaccatccctaataagagatgcggccagaagtagcgtttaccaaactgtcgccagcgcgtcagtattccactcacgttattgccatcccgatcgtattcaaacgtatttagcgcacaaatcttatcattaaagcctgaagtccacagcacgaatgaagataagttgtgcgtaaaagtgcttaagaaaacagcgttcgcaccgttttttatcgttcttataaaattcaaaaaaaaacgactggttcacctggccggagagagtgccagatttgccagtcgaattttatacgacagtataaatgtcgttatgccagtacggctgaaggcgctttgaaggccaacggcagttctgcgtcgtcctggaaggtcacatattcccaggcttcctgttttgcaaggacagcctgcagcagtttgttattcagtgcatgaccggatttataagcggtaaatgcaccaataatattgtgaccacacatgaacaagtcaccgatcgcatcgagcattttgtgacgcacaaattcgtcttcaaaacgcaggccgtcttcgttcagtacgcgataatcgtcaacaacgatggcacaatcgaagctaccgcccaggcacaaaccacgggactgcagatattcgatatcacgcatgaaaccgaacgtacgcgcacggctgatctggcgcataaacgcatcagcggagaagttcatcgcatagcgctggttgctggaatcaatagccggatggttaaaatcgatggtgaaatccagcgaaaaaccattgtacggcttaaattcagcccacttatcgccatcttcgacacgaacagtctctttgatgcgaacaaatttcttggcgcagttcaactcgtcgataccggcgtcaagcagcaggtatacaaacggagcggcgctgccgtccatgatcgggatttccggcgcgttaacttcgataacaatgttatcgatgcccaggcccgcgagagcagcattgaggtgctctacggttgaaatccgtacatcatgctcgttgaccagacacgtacagagcatggtatcacgcacagatttggcatcggccgggaaatctaccggtggattcaagtcggtgcgacgatagatgaccccggtgttggccggcgcagggcgtaacgtcagggtgactttcttgccggtatgtaaaccgacacccgtcgcctgaacgatacgtttaagtgtcctttgtttgatcatcgtattatctcgccaaattacctatccaaccgaagtgtactatacattcggcgggccagtttagcacaaagagcctcgaaacccaaattccagtcaattcttaatcagcttgcttacgcaggaatgctgggatatccagataatccggctctttcgcagtttgcggtgcattgtcattcacgactttagcaaccggcttctgctcctgggtcagcggagccatcccgtgctgctggtagcgatccatcactggctgctgaacctgcttattggtcaccagagtgatttcaggacgtttgtccatgccgatacctgtcgcaacaacagttacgcgcagctcgtcattcatatccgggtcaagagaagtaccgataaccacagtcgcgttgtcggaagcaaatgcacggatggtgttacctaccgtttcgaactcatccagacgcaggtcgaagcccgccgtgatgttaaccagcacgccgcgtgcgccagacaggtcgatatcttccagcagcggagaagagatagccatttcagcagcttcttccgcacggtcttcaccgctcgccacgccagaacccatcattgcgtagcccatttcagacattacggtgcgtacgtctgcaaagtccacgttcatcaaacccggacgagtaatcagttcggcgataccttgcacagcgcctttcagtacatcgttcgctgcgccaaacgcatccagcagggagataccgcggcccagaactttcagcagtttgtcgttcgggatagtgatcagagagtccacatgcttggacagttcagtgatcccctgctcggcgaatgccatacgcttcttgccttcaaagttgaaaggcttagtgacgacagcaacggtcaggatacccaaatcttttgccacttcagcgacgactggtgctgcacctgtaccggtaccaccccccatacccgcagcaataaagaccatgtctgcaccttccagcgccgcacgcagtgcatcgcgatcctcatcagccgcattgcggccaacttctggattagcgcctgcgcccagtcctttggtgataccgctaccgatttgaatcgtctgtccaaccgctgttttacgcagcgcttgtgcatcggtatttaccgcgaagaattcaacaccttcaatgcgctcgcgcaccatgtgttcaacagcattaccgccgccgccgccgacgccgatgactttaatcaccgcgtcattggtaagttccattggttcaaacatagtttctctccgatttgtgcctgtcgcctgaggccgtaatcatcgtcggcctcataaaaattaaaactcttttcgcagccaactattgagtcgcttgatccacgagccaactgatgctgtaacacgtttttctacttcagcttcaccgttaagatgtgactcttttccatagtgaagcaatcccaccgccgtcgaataatacggctcctgagcataatccgttaaaccggtaatgttcagcggcgcgccgatacgcacttgcgtatgaaacacgcgctgagcacaggctgcaagaccttcgatctgcgctgcgccaccagttaatacaatgcctgccgccaggtgatgtttaaccccttgttggcgaagcttttcctgcaactgcaatatctcttcgttgaccaggttgagcagctcggtatagcgcggctcgatcacctctgccagggtctgacgttgcagactccgcggcggacgaccgcctacgctcggcacttccacgctctcatcttttccaacgatggaacccagcgcacaaccgtggcgaactttaatcgcttcggcgtcgcttggcggcgtgccaaaggcgtaagcgatatcactggtcacgacattgccagcataaggaattaccttagtgtggcgcaatgccccaccggtataaacggcgatatccattgtaccaccaccgatatcgacgacgcagacacccagttcacgttcatcttccgtcaataccgaataacttgatgccagtccggcaaatatcagttggtcaactttcagcccacaacgttcaaccgctttgacgatgtttttcgccatatcgttgtgacatgtgatcaggtgcacttttgcctgcatccgcacgcccgaaagtcctaccggattcttgatcccttcctgatagtcaatcgcatactcttgcgggatcacatgcagcacacgatgctcatcgcgcacacgcaccgatttcgcggtatggacgacattttccacatcttcttgcgtcacttcttcttcagaaataggcaccataccaatttcattctggcagctgatgtgcttaccagaaagcgccagatataccgaagagatctgacaatctgccatcaattctgcctggtcaatggcgcgttgtacgcacttgaccacggattcgaggtcgttcaccccgcctttatccataccacgcgacgggcagctgcccacgccaatgatattgaccataccgtcgggcagaacttcccctactaaagcggcaaccttcgcggtaccaatctccagtcctactaccagttttctgtccgtcgccttgatcattgttgttctgcctgtgcctgattttgttgctgagtagattcctctggcggcaagggcgcccagcctactgccgctccagagtcataacgcaaatcaacgtagctaatccgtttgccatcggtttgcgcctgctgctgtaaaaccggataaagttctacaaagcgagccaaacgtttcatcgtatcgccccggccaagattgagcttaatatcgttattcagcgtcaactgccaggaacgccgcgcggtcatcgccgcttccttcagagtaaatctgtcctttgccagcatctgccccatttcgcgatagccctgcaacacttcattggcgctgccttccgggccatacagcattggaagcacctgcttgctggtgcgatctggcggcacgctgaaagtgtttccttccgcgtctaccatatgttgatcattccaccgcgcaatcggcacatattcaaccagatgaatcttcaattcatcaggccactgctttctgacgctcacctgcttaatccacggcaggcgttgttctatttgcgtctggatgatgttgacatcctgggtcataaaggtacctggctcacccaatgccaggatcgactgccggatatcgtcattacgcgtgtaatggcgttcaccggtcaacaccagctttgagagcggcaggcgttgcgcatcttccatccagcccaacacgacccagccgctcaccaacactgtcgttaaaacggtcagcaggaaaaggatccccgccagacgcgttccattattgcggcgagaagaaacctcttcttcgctgtttcgcgtgttcagagcagcctgcgacatattagtccgccagttccagaattcgtactaccaactgcgagaagctcatacctgcctgacgtgccgccatcggcaccaggctgtggctggtcatacccggtgaggtattggcttccagcagataaaactgtccatcgctgtccagcataacgtcaatacgtccccatcctttgcaacctaacgtcgtccatgctttcagcactaatgcctgcaaattggcctcttgtgacgcttccagacctgcggggcagaaatactgtgtctcatcagagagatacttcgcctcataatcatagaaggttccggacggttgaatacgtattgacggtaaaatttcttcaccgagtatcgcaaccgtgaactccggcccacttagccatttttcaatcaatacttcttcatcgtgctgaaatgccaatcttaatgcatcttgtagagcattttctgctactacttttgacattcccacactggaaccttcgcggctcggcttaacgataaccggcaaacccagagcagaaatttctgctaactgcttatcactcaggcctttttcaaactctgcgcgggttaacgctacccacggagcgaccggtaaaccggcaccttgccacagaagtttgctgcgtagtttatccattgaaagcgcagatgccatcactccgctgccggtataaggcaagcccatcagctcgagcatgccctgcagcgtgccatcttcaccgccgcgaccgtgtagcgcgataaacactttctgaaagcccatcgacttcagttgcgtcacgtcgacttctttcgggtcgacaggatacgcgtcaataccgccttcacgcagcccggctaacaccgctgcgccagaattcagagaaacttcccgctcagcggaggtcccacccaacaggaccgcgattttatcagtcatgttgtgcttcctccggagtttgcggcttcagtttgatttcagctaaagaacgggcaatttttccaatattaccagccccctgaacgagaatcaggtcgttaccggttaataccggtgccagcatctcggctacctgcgccgggtcaggcaccagaatgggatcaattttcccacgtccacgaattgtgcgacacagcgaacggctgtccgctcccggaattggcgcttcgccagccggatacacttccagcattaacagggtatcaacctgcgtcagcacattggcgaaatcatcatacaggtcgcgtgtacgggtaaaacggtgcggctgaaacagcattaccaggtttttatccggccagcctgcacgcgccgctttaatagtggcgtccacttccgtcgggtggtggccgtagtcatcgaccaacatcgccgtaccgcttttaccattcactggctccagcgggaattcaccgaggaaatcaaaacggcgaccagtcccctggaagctctccagcgcacgcaaaatagcctcgtcgtcaatgccctcttccgtagcaaccgcaaccgcagctgcggcgttcagcgcgttatgacgacctggcgcattcagggtgacgcgcatcggctctttgtcctggcgcagcagcgtaaagtgcccctgcgggccaatctgctgataatcttctacacgcacgtcggcatcttcgctgaagccgtaagtcgtggtctgacgtcccacacgcggtaacaattcgcggatcaccggatcatcaacacacatcactgcacgaccgtaaaacggcaggttgtgcagaaaattaataaaggtctgttttaaattctcaaagtcgccctggtaggtatccatgtggtcggcttcgatattggtgacaatcgccaccatcggttgcagatgcaggaacgatgcatcactctcatctgcttcggcaatcaggtaccgaccatgccccaaacgcgcatgaacgcccgccgcttttaccagcccaccgttaacgaaggttgggtcgagtcccgcttctgcgtagatgctggaaaccatcgcagtggttgtcgttttgccgtgcgttccggcaatggcgatgccatgacgaaaacgcattaactcagccagcatttcggcacgacggatcaccggaatacgcgcttcatgagctgcgacaatttccgggttatcggcagaaatcgcgctggaaacaacgaccacgctggcatcacgtacgttttccgggcgatggttgaaataaatcgtcgccccaagattcattaactgctgcgtgaccggatttggcgctaaatcggaaccactgatctgataaccttcattggccagaacttcggcaataccgcccataccggcaccaccgatgccgacaaaatgtatgtgccgaacgcgacgcatttcgggcacgatggaacgcagttttgccaattgttgtgtattcattctttacgccattaacttcttaaattcatacgatgcaaaaggcatcgctacaattacgcccgggcagcccggctcacttcatttgccactcgctcggtggcatccggaatggatgcagcgcgggcgcgttctgccatggttaataaggtttctcgcgaccacccggccagggtgttggcgacagcatccacgctaagctgtggctgctcgataattttggctgcgcccgctttttccagcggtagagcattccagtattgctggcggtctttatgttgaaacggcacaaacaacgccggtagtcctgccgcagcgatttcactcaccgttaacgcaccggagcggcaaacgacgacatccgcccacgcatacgccgccgccatatcatcaataaattccgtcactttatgctgcggttgccccgcttcggcatacgcctgttcaacggattgttgcgaacctttaccgctctgatgccagatagtgactgaatcacccagtttcgcagcaacctgcggcattgtctggttaagaatgcgtgcgccctgggaaccacccactaccaacacacgaaccggaccttcacgtccagccaaacgttgctgcggcaacggcagcgccagcacatcggtacgcaccgggttacccaccacttccgcattagggaaagcgcctggaaacgcctgcatcactttggtggcaatcttcgccagccatttattggttaagcccgcaataccgttttgttcatgaagcacaaccggaatgcctaacgaccacgcggccagaccacctggacctgatacgtagccgcccattccgagcaccacgtcaggtttgtacgctttcataatcgcccgcgcctgacgccaggcgttgaagattcgcagtggcgcagctatcagtgcttttataccttttccacgcagaccagagatacgaatgaaatcaatttcgatgccatgttttggcactaagtccgcttccatacggtcggcagtccccagccagcgaacttgccaaccctgagccattagatggtgcgcaaccgccagtcccgggaatacatgtccaccggttccgcctgccatcaccattaatcgctttccttgaccactcatcgtgaacctcgtacaaacgcctgtgctttctccagacgcgtttcataatcaatacgcaacagcatcatgatggctgtcgacataatcagtaagctcgaaccaccgtaactgatcaacggcaatgtcagacctttggtcggtaacatccccgcggccgcgcctacgttcactagcgcctggaagctaaaccagatgccaatggaacaggcgagaaaaccggaaaaacgatggtcaatttctaatgctttacggccaatcgacatcgcacgaaaagcgacgaagaataccattaaaagtgctagtaccacaccgacataacctaattcttcgccgataatggcgaaaataaagtcagtgtgcgcttccggcagatactccagtttttgtacggagttacctaagccttgcccccacagttcgccgcgaccaaacgccatcagcgattgcgttaactgatagccgctgccaaagggatcttcccacgggttccagaatgcggtaacacggcggatacggtacggttcggcgaggatcagcaacacaaccgctgaaatgcccataccgataatggcaatgaactgccacaatttcgctcccgccaggaataacatcgccagcgtagtcacaaacaacaccaccaccgtaccaaggtctggctgtgccagcagtaatactgctaacaccagaatcacgcccatcggtttcaggaagccgcgcaggttattacgtacttcgtcgcctttacgcaccagatagttggcgatatagcaaaacaacgacagttttgtcagctccgcaggctggatacgcagcaagccgagatcgatccaacgcgatgcccctttaacagagctacccactaccagaacgatcatcaacaggatgattgatccgagtagcatcgtagcgctgtaacgttgccagaactccatcggcagacgcagcgtaatgatcgccagaatgaatgccaggatcagatagacgccatcacgcttcgcgaagaagaacggatcgttggttaagcgttgccctatgggcattgacgccgaggtcaccatgataaagccaatcgccgcgaggccgaaggtcagccacagtaaggtgcgatcgtacatgatcaggctgtcggtatctttttcccgcgagcccatcacccagccctttagcgccgtggagatccagaccagaatactgaatcctggcaggcgcggcattttcaggcgagggagagataaacgcatcaacctaactccttcgccagacgggcaaactcattgcctcgttgttcaaagttcttgaactgatcaaggctggcacatgccggggagagcagaaccatatcgcccggctgaacacgcggagccagcaagcgcatcgcctgttccatggtttcggtttgttctgccacttccgggcgtagcgccgccagctgcgcgccgtcccgaccgaaacaatacagacgtacgttatcgccattcaggtaacgcgccagtgggctaaaatctgccgatttaccatcgccgcccagcaacaaatgcagcgtgccgtctacgtgcaggccattcagtgccgcttccgtactgccgacgttggtcgcttttgaatcgttaatccagcgcacaccgttatgctccagcacaacttcaaagcgatgcggcagaccagtgaatgtggttaacgctttcaggctgctggcgcgcggcaaaccagcggcatctgccagtgccagagctgccagtgcattggtgtagttatgctgcccggaaagtttcatttctttcacgttcagcactttctcgcccttcacccgcagccaggtttcaccctgctgatgattcaggtgatagtcacccatgttgacgccaaagctgacacagcgttcatccgcaccgcgaatcggcattgttaaggcatcatcagcattaaccacgcaaatttttgcgttttcgtaaatgcgcagttttgctgcacgatactgttgtaaaccaaacggatagcgatccatatgatcttcagttacgttcagaatggtcgctgctaccgcctgtaaactggaggtggtttcaagctggaagctcgacagctctagcacgtacagttcgcactcatcatccagcagcatcaacgcaggcaggccaatattgccacccacaccaacgttaacccccgccgctttcgccatttcacccactagagtggtgaccgtgcttttgccgttagaaccggtgatcgccacaatcggtgcttgtgcttcacgacagaacagctcgatatcgccaacgatttcgattccggcatcagcggcagcgcttaaggatggatgcgccagtgcaataccgggactggcgacaatcagatctgccgccatcagccattcatcattcagaccgcccgtgtggcgttctacggcttcgggtaatttatccaggccaggcggtgtcatacgcgtatccataacgcgcggcgtcacaccgcgagcgaggaaaaagtccacgcaagaaagcccggtgaggcccaggccgataatgacgacatttttaccctggtaatcagccatgattaacgtaccttcagcgttgccagaccaatcaggaccagcatcagcgaaataatccagaaacgcacaatgacgcgcggttccggccagcctttcagttcatagtggtgatgaatcggtgccatgcggaaaatacgttgtccgcgcagtttaaaggagccgacctgcaggatgacggaaagtgtttctaccacgaacacgccccccataatcaccagcaggaattcctgacgcagcagtacggcgataatgcctaacgcaccacctaacgccagcgaaccgacatcgcccataaagacctgcgccggataggtgttaaaccacaggaagcccagccctgccccgactatcgcggtacagacaatgaccagttccccggcgtgtcgtagatacggtatgtgtaaatagctggcaaagttcatgttgccggtcgcccacgccaccagcgcaaaaccaccggcgacaaatacggtcggcataattgccagaccgtcgagaccatcagtcaggtttaccgcgttgccagtacccacaatgacgaagtaagccagcagaatgtagaacagccccagttgcggcatcacatctttaaagaacggaaccaccagctgcgttgcgggcgtgtctttgccggcaaggtacagcgcgaaggcaacacccagcgcgatcaccgacatccagaaatacttccaacgagcgatcaaccctttggtgtctttacgcaccactttgcgatagtcatcaacaaagccaatgatgccgtaacctaccagcaccaccagtacgcaccagacgtacggattggatgggtaagcccacagcagtacggatatcacaatcgccgtcaggatcataatcccgcccatggtcggcgtaccgcgcttgctgaagtgtgattcaggaccgtcgttacgcactacctgaccaaaggaaagtttttgcaaatgagcaatcatacgcgggcccatccacaatgagatgaacagcgcggtcagcaggctgacgatggcgcgaaacgtcagataggaaaagacgttaaagccggaataatatttgaccaaatgttcggccagccaaactaacatgtcccattctcctgtaaagcgcgtactacctcttccatggcggcactacgtgaacccttaactaaaatcgtaattacctgttgctcagcaatcagtgatttaatacgcgcgataagcgctgttttatctgcaaaatgttcgccaacgccgctggcggtgctgatagcatggctttgtttacccacgcttaacacgcggtcaataccagcagcttttgccgcctcgcccacctgtacatggcaggcttcgctttcagcgcccaattccgccatatcgcccaccaccagcacgcggtagcccggcatttcagccagtacctggactgctgcggtcattgaaccgacattggcgttgtaggagtcgtcgagcagcaactggttttccgccagttggatggggaacagacggcctggaacagctttcagatttgccagccccgctttgatagcatcaagcgttgcgcccacggacatggagagcgcagcggctgccagcgcattcgcaatattgtgacgccctggaagcggcagcagaacatcgacgctacctgttggggtttggagggtaaattccgtaccgtgcgaagtcacatggatgttggtggcggtgaaatcgctgttggcggcattgggtgagaaacgccacactttgcgtgagccaattacgctctgccagttcagccagtcgttgttgtcagcgttcatgatggcgataccgttttccggcaggccgctaaagatttcacctttcgctttcgcgacacccgcaagcgagccaaaaccttccagatgtgccgctgccaggttgttgaccagcgccgcttccgggcgagtcagactcacagtccaggcaatttcgccctgatggttcgcgccaagttcaataactgcgaaatcgtattccggcgttaagcgcaacagcgtcatcggtacaccgatgtcgttgttgagattgcctgccgtataaagtgtgttgccgcactggcttaaaattgccgccgtcatctctttaacagaggttttgccggaggagcccgtcagagcaaccacgcgcgccggaacttgctggcgaacccatgcagccagttcaccaaacgccagacgcgtatccttgacgattaactgcggcagatcgatatccagcggacggctgaccagtagtgcgcccgcgccgccagctttcgcctggtcggcaaaatcatgagcatcgaaacgttcgcctttcagggcaacaaacaggcagcccggcgtcagttttcgcgtgtcagtggttacagcatcaagggtaatatctgcaccttgcagttcaccgttgagaatatcggtaagttggctaagggttacgctaatcatgcaatcacccccagcagacgcgccaccgtgacgcgatcggagtagtccagacgctgattgccaacaatctggtaatcctcatggcctttgcccgcgaccagtaccacatcattctctttagcctgcataacggcgcaagtcaccgcttcagcacggccttccatcactttggcatgtccggcatctaacattcccgccagaatatcgttgatgatggcacgcggttcttcggtacgcgggttatcgtccgttaccaccgccacgtcagcaaactcttcagcaattgcgcccatcagtggacgtttgcctttatcacgatcgccaccacagccaaagacgcaccacagcttgcccgcacagtgcaggcgcgccgcctgtaaggctttttccagtgcatccggcgtatgcgcgtaatccaccactaccgtcggtttgcctggcgcagtgaacacttccatacgtccacaaaccggctgcaggcgtgcggcagttttcagcaggtcagacaacggatagcccagcgccagcagcgtcgccagcgccagcagcaagttgctgacgttaaaagcgcccatcagatggctttcaatttcgccatcgccccaacttgaactaaagcgaatcgtcgcaccgctgtcgtgatagttcacgtcggtcgctttcaaccagcgtccgtgacagttcggattgatatgatcttccattgataccgcaaccgcgtccgacagttttgccagccagcggcggcccacttcatcgtcggcgttaataatcgcctgaccgcaatgatgctcagaataaagcagccatttcgcggcttcgtagtgttccatatcaccatgataatcaaggtgatcgcggcttaagttggtaaagaccgacgccgcaaatttcaatgccgccacacggtgctgtaccagtccgtgggaggaaacttccattgcgcaaaaagtcgcgccctgatccaccagccccgccagctcatgctgaacatcgactgccgaaccggtggtattttctgtcgggatcactttccccagcagaccgttaccaacggtgcccattaccgcgctggtttcgccaagcagttggctccactgcgccagcagctgggtcgtcgtggttttgccgttggtacccgttacgcctacgagacgtaaattgtcagagggttcatggtaaaagcggcccgccagtgcagataaacgctcattgagctggctgagatagatgaccggtacgccgtgcatttcacggatttcaccgtcggtcgcctcatctttcgcctctgcaataatggcagccacaccttgcgctatcgcctgcgggatatatcgacgcccgtccgcctgatgacctactacagctacaaagagatcgcccgccgcagccacacggctgtcgagtgtcatctctcgcagtgctcgcgaaggtgcgtctggcacccacggagcaagaaggtcgcgcaaattacgatctgccacctgtcccctcgccttgattaatcacaaattcatttttatcgcccgttgtcagcgcatccggctcgatgttcatggtacgcaatacgccgcccatgatggcaccaaagaccggcgcggaaacggcgccgccgtagtatttacccgcctgcggatcgttgataacaacaaccagcgcgaagcgcggctgactcgcaggcgcaacgcctgcggtataagcaatatatttattgatgtagcgaccgtccggcccgacctttttcgcggtaccggttttaatggcgatacgatagcccttaatcgccgccttcacgccgccaccacccggtagcgccacgctttccatcatatgcaccacggtgcgaacaatggattccgggaagactcgttcaccgggaaccggggggtcaactttggtaatcgacagtgggcgataaatgccgtagctgccgatagttgcgtagactcgcgctaactgtaacggtgttaccattagcccgtagccgaaagagaaggtggccctctctatgtcagaccaccgttgtttttgaggatataagccactgcgttctccgaccaaccccaaattggtcgcttttcccagtccaaaacgtgagtaagtatctactaacgctgaggacggcatcgctaacgccagcttggaaacaccgacgttactcgacttctgtaataccccggtcagggttaattcgctgtagcgtgccacgtctttgatttcgtggccgttaattcgataaggaatggtattgagtaccgagttttcccgcaccacgccacgttgcaacgcggtcatcaccaccatcggtttaaccgttgagcccggttcaaacacgtcggtgatggtacggttacgcatcgcctctttcggcgtgccgctcagattgttagggttgtatgacggactgttagccatcgccagcacttcaccggtgttgacatccaccagcacggcgctaccagattcagccttgttaaaggccaccgcgttgttcagttcgcgataaaccagcgcctgcaagcgttcatcaatactcagcgccaggttgtgcgctgcctggctgtcagtagaagaaatatcttcaattacgcgaccatagcggtctttacgcacaatgcgctcacccggctgcccggtaagccatttatcgaaactcttctcgacgccctcaatcccctgactatcgacgttagtaaagccgatgaggtgagcagtcacttcgccggatggataataacggcgagattcttcacgcagatgaatccccggcagtttcagttttttgatgtagtccgccatgtcagggtttacctgacgcgccagataaataaagcgccctttcgggttggcgttaatgcgggctgaaagctgatccagcggaatattgagcgcgttagccagcgccttccagcggtcaccgacgctgataccgccagcgtcatgcacttctttcgggtcagcccaaatcgcttttaccggcacgctcaccgctaacgggcgaccagaacggtcagtaatcatgccgcgggaggtggaaacttgctgaacgcgaagagaacgcatgtcgccctctttcaccagcatatccggggagataacttgtaaccacgctacgcgtccgagcagaaaagccagcgccaggagaatacagccgcataacaacgcaaaacgccaactgataaagttggcatgttcttcctgacgttttggtttctgcgttttcgccgctgctttcatgcgtcgcgtttatccttatttttgcactacgatattttcttgtgacggatcaacatgctgcatttgcagcttttccgtggcgatcctttccacccggctatggtcgccgagcgcattctcttcaaggatcaggttgcgccattcaatgtctaaagcatctcgctccagcaccagttgttcgcgctgagcggtcagtaaacgggtatggtgcgccgtggttaccacggtcaccgccgtcaaaataatgcaaatgaacaggcagagtggcagcttcccaaatcgcaaaagatcgtcaccgataacaccaggcaatgcatggcgctcgtggcttcccatcgatcctttaactttgcttagagcttctgtcactctgctgatcatgcgttcgtcctctctgcaatacgcagaactgaactacgggcacgagggttctcagccacctcttcttcgcccggcattaacttgcctagtgctcgcagctgacggccacccagttttttgagctgctcttcagtcatcggtaaccctgccggaacttgcggaccgcggctgttttcacgcataaaacgtttcacaatacggtcttccagcgagtggaagctgatgatcgaaagccgcccacccggggccagcacgttgagcgagctttttagcgcctgctctatctcctccagttcactgtttacccaaatgcgcaccgcctggaaggtccgggtcgcgggatgtttaaacttatctttcaccggcgtagcggcagccacgacttccgccagttctttggtgcgggtcatcggctgttcgcggttacgctcgacaatggcgcgggcaatgcgtttggcaaaacgctcttcaccataggttttcaatacccaggcgatatcggcttcttctgcggtttgtagccattcagcggctgactgcccacgggttgggtccatacgcatgtccagcggaccatcgcgcataaaggaaaagccgcgttcagcatcatcaagttgcggtgaagagacgccaagatcgaggagaatgccgtcgatcttgccgataagatcgcgctcggcaacatattcgcccagcgcggagaaaggtccgtggatgatggagaagcgcggatcatcaatagtcttcgcaacggcgatagcctgcgggtcgcgatcgatcgccagcaaacgcccctcttcgccaagctgcgagaggatcagacgtgagtgaccaccgcgaccaaaagtcccatcaatgtagatgccatcaggacggatattgaggccattaacggcttcatccagcagcaccgtagtatgtttatagttttccatcattttatagagacaagtcctgcagtcgctctgataagtctccagtagccaactgctctgcgtcgatatcttccttgacctgttgatgccaggttgtttcatcccacagctcaaacttgttgaactgtccaaccagcatcacttcttttgtcagcccggcatgttgccgcagtactggcgcgattaacaatcgacctgcgccatccatctgacattcgctggcatgacctaacagtaggcgctgcacacggcgctcaaccgggttcatgctcgacagacgcgataatttttgctcgataatttcccattcaggcagggggtaaagcagcaggcacgggtgatgaatgtcaatggtgcaaaccatttgaccggcagcgttctcaagcagctgctcccgataacgggtaggcactgataagcgccctttgctgtcgagattgactaacgttgctccccggaacatgccagcctcaccccttattcccactttgccccacaatttcccactgaaaggagtttacggagcggaggaaaagcttgtcaagccagtcacaaggcataccgaggtaaaaaacccgatgtttacggctaatatcagcgttgtttattttacgtccaacgtgcgaagcaaattaacgttatgaatagctgtaagaaaaaatccctcatcgtcatcaccgttttaaaatgactaactattttccacagcaaatataaagtgtcagtttgcgacgcgagcggcattttaggacatatcttccccggttaacagtccctgttgcgtctgtgtggcgcttgatgccagcgggtttgcgcaaaagcaaagaaaagtgtttgttaaatcggcaattcatctctgcatgtaacaaaataatgcaaaaacgcgctatcgatatcacttaattattgtgaatttcatctggtgaggtaattaacgggcaggtttataagcatttatcaataatagccaggaatagtcttatttactttaaggatattgatgtccattcccgtactcaacgcgccagagagaaattcacctgacgcgtatttttgttcgcggcttagctacggctgagcacgccgcggcgatagagattacgtttaatgcgcgttaaaccaggttttggcttacgcggttcgtccaggcttgccaggacaatctccagcacacgctctgcgacatcgcggtgacgttgagccactgccagcaccgggcactgtaagaagtcgagcagttcgttatcgccaaaggtggcaattgccaggtcagaaggcagtttgccgtcacgacgtagcgtgacatccatcaccccttgcaacaacgcaaacgacgttgtgaacagtgcctgcggcatcggatgcgtttccagccatttttcgaataactgggcagccgcctcccgctcatagctgttggcataaaggaaatgcacttcgcgcggatcatctttccaggcagtacggaaaccttgttcacgcaggaagctgacagaaagctccggcagcgcgccaagataaagtaccgtctcggcgggaaacttacgtaactcttccgccagcatttcggcatcatcctgatcggcaccaaccacgctggtgaaatgttcacgatcgagggcgcggtccagcgcgacaatcgggaacgggtcgttagcccagcgttgataaaaaggatgctcaggtggcaacgacgtcgaaacaataatggcatcaacctgacgctgcaaaagatgctcgatacaacgcatttcgttgtcgggctgatcttccgagcaggcaatcagcagttgataacccctttgccgcgcctggcgttcaagatagttagcgatgcgggtatagctggtgttctccagatcggggatcacaagaccaatagaacgtgtgcgtccagcacgaagcccagctgccacggcgttcgggtggtaattgtgctcacgcaccacagccatgactttttcaacggttttgtcgctcacacggtattgcttcgctttgccgttaataacatagcttgcagtggtccgcgacactcccgccagccgagcgatttcatccagtttcacaattgccccttgcgtaaaatgtaaaaaccatagccattgtactggtatgggttaaattcattaacatctaagcgcagaaaattaactgcggcaactgcttttattccaggttcccactgatttcgcaaaaaaagcccaacgtgacatgttgggctgcaaattgcgcattgagatcattctcaacgcattattttatcgccgcgcgaaagtccgactacaccagaacgagcaacttccacaattttcgccacatcgcgaatcgatgctaaaaatgcatcaagcttatcgctggtgcctgctaattgaacggtataaagcgagggtgtgacatcaataatttgcccacggaatatttccgtattacgtttaacttcgtcacgcccgtagccgctggcctgaattttcaccagcatgatttcccgctcaacatgcgcgccctgccctaactcgctcacgcgtaatacatcgactagcttgtgtaattgcttttcgatctgctcaagcactttttcatcgcccacggtctggatggtcatacgcgataatgtcggatcgtcagttggtgcaacggtcaggctttcaatgttgtagcctcgctgggaaaaaaggccaatcacgcgggataacgcgcctgattcattttcgagtaagactgataatatccggcgcataatcaggttctctccgttttgcttaaccacatttcatccattccgcccccgcgaatctgcatcgggtagacgtgctcactgccatcgacggtgacatcaacaaacaccaggcgattattacgcacctgttccagcgcctcgctaagtttgctttccagttcttgcggatgagcaatctggatcccgacgtgaccataggcttccgccagacgaacgaaatcgggtagagattgcatataagattgtgaatgacggccggaatagatcatgtcctgccactgtttcaccatccccagatagcggttattgagattcactaccagtaccggcaactcgtattgcaacgcggtagacagttcctggatgttcatctgaatactgccgtcgcccgtgacgcaaaccacggtttcttctggcaacgccattttgacgcccagtgccgcaggtaaaccaaaacccatcgtgccgaggccgccagagttgatccagcgacgcggtttgtcgaatggataataaagcgcagcaaacatctggtgctgcccgacatcggacgtcacgtaagcgtctcccttcgtcaaccgccaaagagtctcgatcaccgcctgcggtttaatcttttcactgtgagagtcatatttcaggcactgacgagcgcgccactgttcaatctgctgccaccagtcgcggatctcatccagcggttgatggacggattcttgcgacaggagttcaagcatttgttcgaggacctggcgagcatcccccacaatcgggatatcagcagtcacggttttagaaatggaagtaggatcaatatcgatatgcagaaccgtggcatttgggcagtacttcgccagattgttcgtcgttcggtcatcaaaacgtaccccgacggcaaaaatcacatccgcgttatgcatcgtcatattagcttcgtaggtgccgtgcattcccagcatgcccagtgcctgacgatgcgttgccggaaacgcccccagccccattaatgaggaaacaacgggcagattcaacgcctccaccgtttcttttagctgctgatgacagcccgccgtgattgccccaccgcctacatagacaaccggtttttttgccgccaccagcgtttgcagagcgcgcttaatttgccctttatgcccggaggtcgtgggattgtaagatcgcatactgaccgactccggccagatgtagggtaatttgttcgccggattaagaatatctttgggtaaatcaacgaccacgggcccaggacgaccacttgccgccagccagaaagcctttttcagcacctgcggaatgtcttccgtttgcttaaccagaaaactgtgtttaaccaccgggcgagaaatccccaccatgtcgcactcctgaaaggcatcgtagcctatcaacgaggtcgctacctgcccggaaaggacaactaagggaatggaatccatataagcggtggcaatgccagtaatcgcattggtcgcccctggacccgacgttaccagcacgacgccgacttccccggtcgcgcgcgccagaccatcggccatatgcaccgccgcctgctcatgacgaactaaaacatgatcgataccacccacggtatgcaatgcatcgtaaatatcaaggaccgcgcctccgggataaccgaatacttgtttaacgccctgatcgataagcgatcggacgaccatctcggctccagacaacatctccatggcctgcctcactgtttgacggaaaaaatgtgtaaaacacattaaccgtccgatcttgcttaagcaattggcagcctgagacataaacacggggtaataagaataaacaggaggaaaggtgaaaagaaacgataaaatcctccattacagaggattaaattgataataaatcggctgaatcccacaacttacagcaatttctctatttttttaattaatcctaaaatagcgaaatcacacattcagaataaaattctacattcaataaaaaatgcagaacaaaccagacattaatgtctgacctattctgcattcagttagcgtttgcaaattgagactaattgctcttccatccactgatggcctttatcgcgcccggcagcttcatgccaggagagataacaggttctgctgttttgttttaacggcagcggtaatacctgtaattctaaggattcagcgaactcttccgccagccaacgcggcgcaatagcgaccagatgcgtttgcgacaccacgctaagtacgctcatcattgccatgccctgatacgcgatactggcttgcttatctaccgtgtcataccacggttgactaaatgacgcgaaacgatcgagcgaaaccgccgcatgttgttcgttataaacatcatgtttcagtaacgggcctttaattgttggatgatttttgctggctaccagcaccatttcatctttaaataatggcacactggtaaattcaggacgatggaagtcttcataactaatcacaaactccgtttcctgataacgcagctgatgttcagtgttctgatttaatgaagacttgaacataacatgtatatttggcgcaatctgctcaatgtgattataaatctgcgaggtcagaatgctgtctaacgggctgcagacacaaagatgaaatacacgttcactactggcaggctcaaagcctgaacctggtaattcattttgtactaattgcaatgcctgacgaactgaaccaaaaagttgaaatgcgcgagcagtcggttgaataccacggccataacgaacaaaaagctcgtcattaaacatcaccttcaggcgtgcaacagcgttactgaccgcaggttgcgacattcccagaacatgagcggcacgggtaatgttttgctcctgcatcacggcatcgaaaacggttaataagttgagatcgaccatgcgtagctgtggcttgcttaactccgccgtctctggatgatctgtttgtacctctggcatacttaactccactgtcacacttaactccctttcccttattggaatgcagagaaataatcctcgagaatatgatttatcatgcatataaaataagaaaaaggaaaatgagtaaaattaggaaaacataaagatacgggttcttataaaaacagaatccattgccgtggaaagcgtcatttaccacagcataataatccataatgtttttgttgcgaaaacaatctaatcataactaccgcgaatactcaatcatccacaaaatggattaaatgtgcttttttaataattaatttatatgtttaatgcattaatccttaacattaattgatcaataatattcaccaaatcaatatcaaaaaattcgcaaaacatataattcaatacaaatcatcaggataggttttgtaacgcgtgcattttatccccctttccctcgtcgattagatgcaaaaatttattctgaaatatgtcaaccgatgaaaagcggcggtggttaagcagaaattaatatcgcttgttttaaccaccgcagcacaattagctaatttgacggatgcagaactcatgctggcgggacgtttttattacgtcagggttgacatccgtttttgtatccagtaactctaaaagcatatcgcattcatctggagctgatttaatgactcacatcgttcgctttatcggtctactactactaaacgcatcttctttgcgcggtagacgagtgagcggcatccagcattaagccagcacgcagtcaaacaaaaaacccgcgccattgcgcgggtttttttatgcccgaagcgaggcgctcaaaaagagacaaggacccaaaccatgagccagcaagtcattattttcgataccacattgcgcgacggtgaacaggcgttacaggcaagcttgagtgtgaaagaaaaactgcaaattgcgctggcccttgagcgtatgggtgttgacgtgatggaagtcgggttccccgtctcttcgccgggtgattttgaatcagtgcaaaccatcgctcgccaggttaaaaacagccgcgtatgcgcgttagctcgctgcgtggaaaaggatatcgacgtggcggccgaatctctgaaagtcgccgaagccttccggattcatacctttattgccacttcgccaatgcacattgccaccaagctgcgtagcacgctggacgaggtgatcgaacgcgctatctatatggtgaaacgcgcccgtaattacaccgatgatgttgaattttcttgcgaagatgccggacgcaccccaattgccgatctggcgcgagtggtcgaagcggcgattaatgccggtgccaccaccatcaacatcccggacaccgtgggctacaccatgccatttgagttcgccggaatcatcagcgggctgtatgaacgcgtacccaacatcgacaaagccattatttccgtacatacccacgacgatttgggcctggcggtcggaaactcactggcggcggtacatgccggtgcacgccaggtggaaggtgcaatgaacgggatcggcgagcgtgccggtaactgttccctggaagaagtgatcatggcgatcaaagttcgtaaggatattctcaacgttcataccgccattaatcaccaggaaatatggcgcaccagccaattagttagccagatttgtaatatgccgatcccggcaaacaaagccattgttggcagcggcgcattcgcacactcctccggtattcatcaggatggtgtgctgaaaaaccgcgaaaactacgaaatcatgacaccagaatctattggtttgaaccaaatccagctgaatctgacctctcgttcgggacgtgcggcagtaaaacaccgcatggatgagatggggtataaagaaagtgaatataatttagacaatttgtacgatgccttcctgaagctggcggacaaaaaaggtcaggtgtttgattacgatctggaggcactggccttcatcggtaagcagcaagaagagccggagcatttccgtctggattacttcagcgtgcagtctggctctaacgatattgccactgccgccgtcaaactggcctgcggcgaagaagtcaaagcagaagccgccaacggtaacggtccggtcgatgccgtctatcaggcgataaaccgcatcactgactataacgtcgaactggtgaagtacagcctgaccgccaaaggccacggtaaagatgcgctgggtcaggtggatattgtcgccaactacaatggtcgccgcttccacggcgtcggcctggccaccgatattgtcgagtcctccgccaaagccatggtgcacgtacttaacaatatctggcgtgccacagaagtcgaaaaagagttgcaacgcaaagctcaacacaacgaaaacaacaaggaaaccgtgtgatgtcgaagaattaccatattgccgttttgcccggagatgggatcgggccggaagtgatgacccaggcgctgaaagtgctggatgccgtgcgcaaccgctttgcgatgcgcatcaccaccagccattacgatgtaggcggcgcagccattgataaccacgggcagccgctgccgcctgcgacggttgaaggttgtgagcaagccgatgccgtgctgtttggctcggtaggtggtccgaagtgggaacatttgccgccagaccagcaaccagaacgcggcgcactgttgcctttgcgtaaacacttcaaattattcagcaatctgcgtccggcaaaactgtatcaggggctggaagcattctgtccgctgcgtgctgacattgccgctaacggcttcgacatcctgtgtgtgcgcgaactgaccggcggcatctatttcggtcagccaaaaggccgcgaaggtagtggacaatatgaaaaagcgtttgataccgaggtgtatcaccgttttgagattgaacgtatcgcccgcatcgcgtttgaatctgctcgtaaacgtcgccataaagtgacgtctatcgacaaagccaacgtgctgcaatcctctattttatggcgggagatcgttaacgagatcgccacggaatacccggatgtcgaactggcgcatatgtacatcgacaacgccaccatgcagctgattaaagatccatcacagtttgacgttctgctgtgctccaacctgtttggcgacattctgtctgacgagtgcgcaatgatcactggctcaatggggatgttgccttccgccagcctgaacgaacaaggttttggtctgtatgaaccggcaggcggctccgcaccagatatcgcaggcaaaaacatcgccaacccgattgcacaaatcctgtcgctggcactgctgctgcgttacagcctggatgccgatgatgcggcttccgccattgaacgcgccattaaccgcgcattagaagaaggcattcgcaccggagatttagcccgtggcgctgccgccgttagtaccaatgaaatgggcgatatcattgcccgctacgtggcagaaggggtgtaatcatggctaagacgttatacgaaaaattgttcgacgctcacgtagtgtacgaagccgaaaacgaaaccccgctgttatatatcgaccgccacctggtgcatgaagtgacctcaccgcaggcgttcgatggtctgcgcgcccacggtcgcccggtacgtcagccggggaaaaccttcgccaccatggatcacaacgtctctactcagaccaaagacattaatgcctgcggtgaaatggcgcgcatccagatgcaggagctgatcaaaaactgcaaagagtttggcgtcgagctgtatgacctgaatcacccgtatcaggggatcgtccatgtaatggggccggaacagggcgtcacattgccggggatgactattgtctgcggcgactcgcataccgccacccacggcgcgtttggcgcactggcctttggtatcggcacttccgaagttgaacacgtactggcaacgcaaaccctgaaacagggtcgtgcgaagaccatgaaaattgaagtccagggcaaagccgcgccgggcattaccgcgaaagatatcgtgctggcgattatcggtaaaactggcagcgcaggcggcaccgggcatgtggtggagttttgcggcgaagcaatccgtgatttaagcatggaaggtcgtatgaccctgtgcaatatggcaatcgaaatgggcgcgaaagccggtctggttgcaccggacgaaaccacctttaactatgtcaaaggccgtctgcatgcgccgaaaggcaaagatttcgacgacgccgttgcctactggaaaactctgcaaaccgacgaaggcgcaactttcgataccgttgtgactttgcgggcagaagagatttcaccgcaggtcacctggggcaccaatccaggtcaggtgatttccgtgaacgacaatattcccgatccggcttcgtttgccgatccggttgaacgcgcgtcggcagaaaaagcgctggcctatatggggctgaaaccgggtattccgctgacagaagtggctatcgacaaagtgtttatcggttcctgcactaactcgcgtattgaagatttacgcgcggcggctgaaatcgccaaaggacggaaagtcgcgccaggcgtgcaggcactggtggttcccggctctggcccggtaaaagcccaggcggaagcggaaggtctggacaaaatctttattgaagccggttttgaatggcgcttgccaggttgctcaatgtgtctggcgatgaacaacgatcgcctgaatccgggtgagcgttgtgcctccaccagcaaccgtaactttgaaggccgccaggggcgtggagggcgcacgcatctggtcagcccggcaatggctgccgctgctgcggtgaccggacatttcgccgacattcgcaacattaaataaggagcacaccatggcagagaaatttatcaaacacacaggcctggtggttccgctggatgccgccaatgtcgataccgatgcaatcatcccgaaacagtttttgcagaaagtgacccgtactggttttggcgcgcatctgtttaacgactggcgttttctggatgaaaaaggccaacagccaaacccggacttcgtgctgaacttcccgcagtatcagggcgcttccattttgctggcacgagaaaacttcggctgcggttcctcgcgtgagcacgcgccgtgggcattgaccgattacggttttaaagtggtgattgccccgagttttgctgacatcttctacggcaacagctttaacaaccagctgctgccggtgaaattaagcgatgccgaagtggacgaactgtttgcgctggtgaaagccaatccggggattcattttgatgtagacctggaagcgcaagaggtgaaagcgggagagaaaacgtatcgctttaccatcgatgccttccgccgccactgcatgatgaacggtctggacagcatcggcctgacattgcagcacgacgacgccattgcgtcttatgaagagaagcaaccggcatttatgcgttagtttgtaaaccgtccggcactcaatcgccaaaaagaaaaaagccagcagataatcactgctggcgtggcgattaacaccaatactcagtcacacatgatgtccgcaaatcagtagtcagaatgactcccctcccactgcatcagttcttcaagcatagttaatcgttgtgggacgcttaaccaacgcaaccagcacaacttcgctgtcgcggtaaaatagtgctgataaaactgacgcatggggcacctccttgcttcatcgttaggaattattgacttaatatagggaaaataaaattgctgtcttttgcgcaggagttccccttttatgccatctgctcgtctgcaacaacagttcatccgcctgtggcaatgctgcgagggtaaatcgcaggacacaacgctcaacgaactggcagcgttattgagctgctcgcgtcgtcatatgcgtaccctgctcaacaccatgcaggatcgcggctggctgacgtgggaagcggaagtcgggcgcggtaaacgctcgcgtctgacattcctctataccgggctggcgcttcagcaacagcgggcggaagacctgctggagcaggatcgtatcgaccaactagtgcagttggttggcgacaaagcgactgtgcggcaaatgctggtttctcatctgggccgcagcttccgccaggggcggcacatcctgcgcgtgctctactatcgtccgttgcgtaatctgctacctggcagcgcattgcgccgttccgaaacccatattgcccggcaaatcttcagttcgctaacgcgcataaatgaggaaaatggggaactggaagcagacatcgcccaccactggcagcaaatttcaccgcttcactggcgtttctttttgcgtccaggagtccattttcatcatggtcgtgaactggaaatggacgacgtgatcgcctctttaaaacgaatcaatacgctgccgctctattcgcatattgctgacattgtgtcgccgacgccctggacgctggatatccatctcacgcaaccggaccgctggttaccgttactgctggggcaagttccggcgatgatcctgccgcgcgaatgggaaaccctcagcaactttgccagccatcccatcggaacgggtccttatgcggtgatccgcaacagcagcaatcaactgaaaattcaggcattcgacgacttctttggttatcgggcattaatcgacgaagttaacgtctgggtcttgccggaaattgctgatgaccccgcgggaggcctgatgctgaaaggaccgcaagacgaggaaaaagagattgaaagccgccttgaagaaggttgttactatttactgttcgacagccgtacccatcgcggggcgaatcagcaagtcagagactggataagctatgtgctttcgccgaccaatctggtttatttcgccgaggaacagtaccagcagctgtggtttccggcctatgggctgcttccccgttggcaccatacccgcaccataaagagcgaaaaaccggctggtctggaaagcctcaccctgaccttttatcaggatcacagtgagcatagggtgattgccgggatcatgcagcagattctggcaagtcaccaggtcacgctggaaatcaaagagatcagctacgatcagtggcatgaaggagagatcgagagcgatatctggcttaacagcgccaactttacgctgccgctggatttttcgctattcgcgcacctgtgcgaggtgccgctgctccaacactgtattccgatcgactggcaagccgacgccgcccgctggcgcaatggcgaaatgaacctggcgaactggtgccagcaactggtcgccagcaaagcaatggtgccgcttatccaccactggctgattattcagggacaacgcagtatgcgcggcctgcgcatgaacaccctcggctggttcgattttaaatcagcgtggtttgcgccgccggatccagagtagcttgcgccttttggcggtcatgagcgcattttttatatttagacggaatgaataaaatacattacttttatattttctctgttttatgcatcgtctgattagagtcgcaaataagattatctcgaatcgtgtgcgattcattgtctgaaaaatgacgactccgcactccctgaaaacaaggcagagtctggattcgactccagactccaactcaaatttcttttgccagaataaaaatacacgctcataatttcagtaacacgctgttgtttgaggctaatcagacgagattttatcttgcgtgggtgtgggatgttgatgttaagtgacaggcatatgaaaattagcataccgggtagaattcagtatttctgcgcaatattgttttatataaaaaataagtcagtgtgttttttaccttattttatatatagtggtcagcaccaacttaaaaaagaaagggcgttcctgccccttccctatttattattctggctcaatcaataattgcgccacgactgcgcaatttagcgctatcctggccggaaaggtcagccttgctcaggttaatcccgcgcacgttagtatcttccatataagcattgttcaggatggtattgtccatttttgcattgcgcaggagtgtatcgtccaggtcagtatcggacatgtcagtatcggacaggttagtatcggacaggtcagagctaataactttggcattgttcattttagcaccgtgcaggtcagcaccgagtaggttagaactgcacagactgatcttgtccatttcagcattgctcaggtcagccttgcgaaggcaagcaccattaagggaaatcccggaaaggtaagcattactcagatcaatgcccccggtactggggcttattcccaattgcaacttctgagtatatatctctatatttccaatataaaaactgacacataacatattatctggcgagattgagcccctcgcctgcatcatttccggatcttttgcgtgttctttgagttcattaaatttttttagccggtgggtaaacctatcacgcgccttctcgtcgacagccccggtaaagtattttgagtagccatcacaattctggaaataaaatgcatccttcagaatttgccttgccgcagtctgggaatgtttatctgaccggaagagattgcgtaacgtctcccatagctcttcaaagatattcatattctcggtctttttgaccaggttaaccatcctgataatctgagagtgagtaaggcctggatctttagtggtattacttgcagggatactaatctgttctgggtttcttactttcatgctgatagctccactatgagttaaaaactcagaataagcgtcctgaataagaatactgtcaaaaatcgctcattcacgcaataagccgttgcattaccgattttgactgtgctaagggattctttcggttcaaagcttcccagctatgcaaatacgtccttgatagctgaacgaatattggcttttttaatacgccttctctatggattgctggttgataacaaaatcactacactaacgccgttctcaacggggtgccacgcagacgcgtgcgctgagaaaatacccgtcgaacctgatccggataacgccggcgaagggatttgaggctccttctcaagtcctttgccactcttttttgaggtgcaaagtgttaaaaaaatatcttcccctgctgttgctgtgcacagcgcccgttttcgcgaaacctgttctgactgtttatacctacgattccttcgccgctgactgggggccaggcccagtggtaaaaaaagcctttgaagccgactgtaattgcgaactgaaactggtagcgctggaagatggcgtttcgcttctcaaccgtctgcggatggaaggcaaaaacagtaaagctgatgtggtgctggggctggataacaatctgttagacgccgccagcaaaaccggactgtttgccaaaagcggtgtggcagcagatgcggtaaatgtacccggcggctggaataatgacactttcgtaccgtttgattacggctatttcgccttcgtctatgacaagaacaaactgaaaaatccgccgcaaagcctgaaagaattggttgagagcgatcaaaactggcgggtgatttatcaggatccgcgcaccagtacgccggggctgggcctgctgttgtggatgcaaaaagtctatggcgatgacgccccacaagcctggcagaaactggcgaagaaaacggtcacggtcaccaaaggctggagcgaagcctacggcctgtttttaaaaggcgaaagcgatctggtactgagttacaccacctctccggcttatcacattctcgaagagaagaaagataactacgccaccgcgaacttcagcgaaggtcactatttgcaagtggaagtcgccgcccgcaccgctgccagcaagcagccagagctggcgcaaaaattcctccagtttatggtttctccggctttccagaatgcgatcccaaccggcaactggatgtatccggtggcaaatgtcacgctgcctgccgggtttgaacaattgaccaaaccggcaaccacgctggagttcacgccagccgaagtggcggcacaacgtcaggcatggattagcgaatggcaacgcgccgtcagccgttaattcccggctggttaattccaggtgtaagcgccgctacgcttgtggtggcggttgcgctggcggcgtttctcgccctgtggtggaacgcgccgcagggtgactgggtggcaatctggcaggacagctacctgtggcatgtggtgcgcttctccttctggcaggcgtttctctcggcgctactctctgtcgtacccgcgatattcctcgcccgcgcgctctatcgcaggcgctttccgggtcggctggcgctgttgcgtctgtgcgcaatgaccttgatcctcccggtgctggttgctgttttcggcattcttagcgtctatggtcgccagggctggctggcatcgctctgccaatcgctcggtctggagtggaccttttcgccctacggcctgcaaggcattttgctggcccatgtgttttttaatctgccgatggcgagccgtttattacttcaggcactggaaaacattcccggcgaacaacgtcaacttgccgcccagcttgggatgcgtggctggcacttctttcgtttcgtcgaatggccgtggttacggcgacaaatcccgccagttgctgcgcttatctttatgctctgtttcgccagcttcgccaccgtgttgtcgctggggggcggtccgcaggcgaccactatcgaactggctatttatcaggcgctgagttacgactacgatcccacccgcgcggcgatgctggcgctgatccagatggtgtgttgccttgggctggtgctgttgagtcagcgattgagtaaggccattgcgcccggcaccacgctgctgcaaggctggcgcgacccggacgatcgtctgcatagccgcatttgcgacacggtgttaattgtgctggcgctgttgctgttgctgccaccgttactggcggtgctcgtcgatgggataaatcgccagttgccggaagtgctggcgcagccggtgctgtggcaggcgctgtggacctcgttgcgtattgcgctggtggcaggcgtattatgcgtagtgctgaccatgatgctgctatggagcagtcgcgaactgcgggcgcggcaaaaaatgctggcgggtcaggcgctggagatgagcggtatgttgatcctcgccatgccggggattgtgctggcaacgggcttctttttgctgctcaacaacaccattggcctgccacaatctgctgacggcattgtgattttcaccaatgcgttaatggcgatcccttatgcgctgaaggtgctggaaaacccgatgcgcgatatcaccgcgcgttacagtatgttgtgtcagtcgctgggcattgaaggctggtcacgcttaaaagtggtggagctgcgcgccctgaaacgcccacttgcgcaggcactggcctttgcttgtgtgctatcgattggtgattttggcgtggtggcgttgttcggtaacgatgatttccgcaccctgccgttttatctctaccagcaaattggctcctatcgcagccaggacggcgcggtcaccgcgttaattctgctgctactctgttttctgctgtttaccgtgattgaaaaactaccggggcgaaatgttaaaactgactgatatcacctggctttaccaccatttgccgatgcgttttagcttaacggtggaacggggcgagcaggtggcgatcctcgggccaagcggcgcgggtaaaagtaccctgctgaatttgatcgccggttttctgacgccagccagcggttcgctgactatcgacggcgttgatcacacctctacgccgccgtcacgccgtccggtgtcgatgctgtttcaggagaacaacctgttcagtcacctgacggtcgcgcagaacatcgggctggggcttaatccaggattgaagctgaacgcggcacaacaggagaaaatgcacgctatcgcccgccagatggggattgataatttaatggcgcgattaccgggcgagctttctggcggtcaacgacagcgcgtggcgttagcgcgttgtctggtgcgcgaacagccgattttattgctcgatgaaccgttctctgcgctcgatccggcgttacgtcaagagatgttgacgctggtgagcacgagctgccagcagcaaaaaatgacgctattgatggtgtcgcacagtgtggaagatgcggcgcggatcgccacacgctcggtggtggtcgccgacgggcgcatcgcctggcagggtatgaccgatgagttgttgagcggtaaggcgagtgcttcagcactattggggattacgggttagtatgcactgtcggatgcggcgtgaacgccttatccgacctacggacagtgcgttttgtaggcctgataagacgcggcaagcgtcgcatcaggcaacccgcacaaggctatcccctaacccccaaccactttacgcaaaatatcgatatacatcggcatcaacgggtggcgaattaacaccaccagcgccactacaccgacggcagaaatcaacggcgtcagccacaacaaacgaccgcgcgacaaataatgacttaaacgatcggttgctttaccgctgcgccataaccgccagcacagccagccaccaacccacaaaaataccgccgtcgccagcagcaaccatttaaactcgccgctctgcattccggctggaatatcgatcgccgcacccgccagaatccccggcaggaagtaaaacggtggccacagcaggcagccgataatattcggcgtaataaattttgccaccgggagatccagcattcccgccaccattggcaccagcggacgcgtcgggccaacaaaacgaccgaccagaatggtgaacatgctgtgttgatgcaacgcatgttcagttttatcaagtagtgctttgtttttcttcagaaatgaccagcgatgcaatggctttttaaaacgccagcccagccagaaagagatccagtcgcccagcaggcaaccgacgatccctgccagccaggcgtgccagaaacttaactcgccactgccaatcagcgcccccagtcccgccattagcaccgtaccgggtaaaatcaaaccgaccagcgccagcgactccagaaaggccaccaacaccaccgctatcaatgaatacacggtggattgggtaataaagtgttccagcaatgcttgcataatgtgcctgtcaaatggacgaagcagggattctgcaaaccctatgctactccgtcaagtcgtcaattgtctgattcgttaccaattatgacaacttgacggctacatcattcactttttcttcacaaccggcacggaactcgctcggactggccccggtgcattttttaaatactcgcgagaaatagagttgatcgtcaaaaccaacattgcgaccgacggtagcaataggcatccgggtggtgctcaaaagcagcttcgcctgactaatgcgttggtcctcgcgccagcttaagacgctaattcctaactgctggcggaacagatgcgacagacgcgacggcgacaggcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaacccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcagacaaattctcgtccctgatttttcaccaccccctggccgcgtatggtgagattgagaatataacccttcattcccagtggtcggtcgataaaaaaatcgagataaccgttggcctcaatcggcgttaaacccgccaccagatgggcgttaaacgagtatcccggcagcaggggatcattttgcgcttcagccatacttttcatactcccgccattcagagaagaaaccaattgtccatattgcatcagacattgccgtcactgcgtcttttactggctcttctcgctaatccaaccggtaaccccgcttattaaaagcattctgtaacaaagtgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttttcgcaactctctactgtttctccatacccgtttttttggatggagtgaaacgatggcgattgcaattggcctcgattttggcagtgattctgtgcgagctttggcggtggactgcgccaccggtgaagagatcgccaccagcgtagagtggtatccccgttggcagaaagggcaattttgtgatgccccaaataaccagttccgtcatcatccgcgtgactacattgagtcaatggaagcggcgctgaaaaccgtgcttgcagagcttagcgccgagcagcgcgcagctgtggtcgggattggcgttgacacaaccggctcgacgcccgcaccgattgacgcggacggtaacgtcctggcgctgcgcccggagtttgccgaaaacccgaacgcgatgttcgtattgtggaaagaccacaccgcggttgaagaagcggaagagattacccgcttatgtcacacgccaggcaacgttgactactcccgctatattggcggtatttattccagcgaatggttctgggcaaaaatactgcatgtaactcgccaggacagcgccgtggcgcaatctgccgcatcgtggattgagctgtgcgactgggtgccagctctgctttccggtaccacgcgcccgcaggatattcgtcgcggacgttgcagcgccgggcataagtcgctatggcacgaaagctggggcggcctgccgccagccagtttctttgacgaactggacccgatcctcaatcgccatttgccttccccgctgttcactgatacctggactgccgatattccggtgggcactttatgcccggaatgggcgcagcgtctcggcctgcctgaaagcgtggtgatttccggcggcgcgtttgactgccatatgggcgcagttggcgcaggcgcacagcctaacgctctggtaaaagttatcggtacttccacctgcgacattctgattgccgacaaacagagcgttggcgagcgggcagtgaaaggtatttgcggtcaggttgatggcagcgtggtgcctggatttatcggtctggaagcaggccaatcggcgtttggcgatatctacgcctggttcggtcgcgtactcggctggccgctggaacagcttgccgcccagcatccggaactgaaagagcaaatcaacgccagccagaaacaactgcttccggcgctgaccgaagcatgggccaaaaatccgtctctggatcacctgccggtggtgctcgactggtttaacggccgccgcacaccgaacgctaaccaacgcctgaaaggggtgattaccgatcttaacctcgctaccgacgctccgctgctgttcggcggtttgattgctgccaccgcctttggcgcacgcgcaatcatggagtgctttaccgatcaggggatcgccgttaataacgtgatggcgctgggcggcatcgcgcggaaaaaccaggtcattatgcaggcctgctgcgacgtgctgaatcgcccgctgcaaattgttgcctctgaccagtgctgtgcgctcggtgcggcgattttcgctgccgtcgccgcgaaagtgcacgcagacatcccatcagcccagcaaaaaatggccagtgcggtcgagaaaaccctgcaaccgcgcagcgaacaggcacaacgctttgaacagctttatcgccgctatcagcaatgggcgatgagcgccgaacaacattatcttccaacttccgccccggcacaggctgcccaggccgttccgactctataaggacacgacaatgacgatttttgataattatgaagtgtggtttgtaattggcagccagcatctgtatggcccggaaaccctgcgtcaggtcacccaacatgccgagcacgttgttaatgcgctgaatacggaagcgaagctgccctgcaaactggtgttgaaaccgctgggcaccacgccggatgaaatcaccgctatttgccgtgacgcgaattacgacgatcgttgcgccggcctggtagtgtggctgcacaccttttccccggccaaaatgtggatcaacggcctgaccatgctcaacaaaccgttgctgcaattccacacccagtttaacgcggcgctgccgtgggatagcatcgatatggactttatgaacctgaaccagactgcacatggcggtcgcgagttcggcttcattggcgcgcgtatgcgtcagcaacatgccgtcgttaccggtcactggcaggataaacaagcacatgagcgtatcggctcctggatgcgtcaggcggtatctaaacaggatacccgtcatctgaaagtctgccgttttggcgataacatgcgtgaagtggcggtcaccgatggcgataaagttgccgcacagatcaagttcggtttctccatcaatacctgggcggttggcgatctggtgcaggtagtgaactccatcagcgatggcgatgttaacgcgctggtcgatgagtacgaaagctgctacaccatgacgcctgccacacaaatccacggcgaaaaacgccagaacgtgctggaagcggcgcgtattgagctggggatgaagcgtttcctggaacaaggtggcttccacgcgttcaccaccacctttgaagatttgcacggtctgaaacagcttcctggtctggccgtacagcgtctgatgcagcagggttacggctttgcgggcgaaggcgactggaaaactgccgccctgcttcgcatcatgaaggtgatgtcaaccggtctgcagggcggcacctcctttatggaggactacacctatcacttcgagaaaggcaatgacctggtgctcggctcccacatgctggaagtctgcccgtcgatcgccgcagaagagaaaccgatcctcgacgttcagcatctcggtattggtggtaaggacgatcctgcccgcctgatcttcaatacccaaaccggcccagccattgtcgccagcttgattgatctcggcgatcgttaccgtctgctggttaactgcatcgacacagtgaaaacaccgcactccctgccgaaactgccggtggcgaatgcgctgtggaaagcgcaaccggatctgccaactgcttccgaagcgtggatccttgctggtggcgcgcaccataccgttttcagccatgcgctgaacctcaacgatatgcgccagttcgccgagatgcacgacattgaaatcacggtgattgataacgacacccgcctgccagcgtttaaagacgcgctgcgctggaacgaagtgtattacggatttcgtcgctaagtagctgcatcaggtatgtaacgcctgatgcgacgctggcgcgtcttatcaggcctacacgctgcgattttgtaggccggataagcaaagcgcatccggcattcaacgcctgatgcgatgctggcgcgtcttatcaggcctacgcgctgcgattttgtaggccgggtaagcaaagcgcatccggcacgaaggagtcaacatgttagaagatctcaaacgccaggtattagaagccaatttggcgctgccaaaacataacctggtcacgctcacatggggcaacgtcagcgccgttgatcgcgagcgcggcgtctttgtgatcaaaccttccggcgtcgattacaacgtcatgaccgctgacgatatggtcgtggtcagcatcgaaaccggtgaagtggttgaaggaacgaaaaagccctcctccgacacgccaactcaccggctgctctatcaggcattcccgtccattggcggcattgtgcatacgcactcgcgccacgccaccatctgggcgcaggcgggccagtcaattccggcaaccggtaccacccacgccgactatttctacggcaccattccctgcacccgcaaaatgaccgacgcagaaatcaacggtgaatatgagtgggaaaccggtaacgtcatcgtagaaaccttcgaaaaacagggtatcgacgcagcacaaatgcccggcgttctggtccattctcacggcccgtttgcatggggcaaaaatgccgaagatgcggtgcacaacgccatcgtgctggaagaagtcgcttatatggggattttctgccgccagcttgctccgcagttaccggatatgcagcaaacgttgctggataagcactatctgcgtaagcatggcgcaaaagcctattacgggcagtaatgactgtataaaaccacagccaatcaaacgaaaccaggctatactcaagcctggttttttattggattttcagcgtggcgcaggcaggttttatcttaacccgacactggcgggataccccgcaagggacagaggtctccttctggctggcaacggacaacgggccgttgcaggttacgcttgcaccgcaagagtccgtggcatttattcccgccgatcatgttccccgcgctcagcatattttgcagggtgaacaaggctttcgcctgacgccgctggcgttaaaagattttcaccgccagccggtgtatggcctttactgtcgcgcccatcgccagttgataaattacgaaaagcgcctgcgtgaaggtggcgttaccgtctacgaggccgatgtgcgcccgccagaacgctatctgatggagcggtttatcacctctccggtgtgggtcgagggtgatatgcgcaatggcgctatcgttaatgcccgtctgaaaccgcatcccgactaccgtccgccgctcaagtgggtttctattgatattgaaaccacccgccacggtgagctgtactgcatcggcctggaaggctgcgggcagcgcatcgtttatatgctggggccagagaatggcgacacctccgcgctcgattttaaactggaatatgtcgccagtcgcccgcagctactggaaaaactcaacgcctggtttgcgactcacgatcccgatgtgatcatcggctggaacgtggtgcaattcgatctacgaatgctgcaaaaacatgccgagcgttctcgtattccgctgcggctggggcgcgataacagtgagctggagtggcgcgagcacggctttaaaaacggcgtcttttttgcccaggccaaagggcgactgattatcgacggtatcgaggcgctgaaatccgcgttctggaatttctcttcattctcgctggaaaccgtcgctcaggagttattaggcgaaggaaaatctatcgataacccgtgggatcggatggacgaaattgaccgccgtttcgccgaagataaacctgcgctggcaacttataacctgaaagattgcgagctggtgacgcagatcttccacaaaactgaaatcatgccatttttactcgaacgagcgacggtgaacggcctgccggtggatcggcacggcggttcggtggcagcgtttggtcatctctattttccgcgaatgcatcgcgctggttatgtcgcgcctaatctcggcgaagtgccgccacacgccagccctggcggctatgtgatggattcgcggccagggctttatgattcggtactggtgctggactacaaaagcctgtacccgtcgatcatccgcacctttctgattgatcccgtcgggctggtggaaggcatggcgcagcctgatccagagcacagcaccgaaggttttctcgatgcctggttctcgcgggagaaacattgcctgccggagattgtgactaacatctggcacgggcgcgatgaagccaaacgtcagggtaataagccgctttcgcaggcgctgaagatcattatgaatgccttttatggcgtgcttggcaccaccgcctgccgcttcttcgatccgcgcctggcgtcgtcgatcaccatgcgtggtcatcagatcatgcggcaaaccaaagcgttgattgaagcgcagggctacgacgtgatctacggcgataccgactcaacgtttgtctggttgaaaggcgcacattcggaagaagaagcggcgaaaattggtcgtgcactggtgcagcacgttaacgcctggtgggcagaaacgctgcaaaaacaacggctgaccagcgcattagaactggagtatgaaacccatttctgccgttttctgatgccaaccattcgcggagccgataccggtagtaaaaagcgttatgccgggctgattcaggagggcgataaacagcggatggtgtttaaagggctggaaaccgtgcgcaccgactggacgccgctggcccagcagtttcagcaggagctgtacctgcgtatcttccgcaacgagccatatcaggagtacgtccgcgaaaccatcgacaaactgatggcgggtgaactggatgcgcggctggtttaccgtaaacgccttcgccgtccgctgagcgaatatcagcgtaatgttccgcctcatgtacgcgctgcacgccttgccgatgaagaaaaccaaaagcgcggtcgccccttgcaatatcagaaccgcggcaccattaagtacgtatggaccaccaacggcccggagccgctggactaccaacgttcaccactggattacgaacactatctgacccgccagctacaacccgtggcggagggaatactcccttttattgaggataattttgctacacttatgaccgggcaacttgggctattttgagcaaaaaaagagttcgccagataccattttgatgcgtgacgaatgctttgccatccagtaccatagcgccctttccattcctggacctgaataacaccactacctcataagcacggtagcgggtggttattgcctgcaattaaagatatagagccgaacacatatgccttttacacttggtcaacgctggatcagcgatacagaaagcgaattgggacttggaaccgttgtcgcggtggatgcgcgaactgtcactttacttttcccatctactggtgaaaaccgtctgtacgcacgcagtgattcccccgtgacccgcgtgatgttcaaccctggtgataccattaccagccatgacggctggcagatgcaagtcgaagaagtaaaagaagaaaatggcttgctgacttatatcggtactcgcctggatactgaagagtccggcgtagccctgcgtgaagttttccttgatagcaaactggtgttcagcaaaccgcaggaccgtctgtttgccgggcagattgaccgaatggaccgctttgcgctgcgttatcgcgcgcgtaagtattccagcgaacagttccgtatgccgtacagcggcctgcgcggtcagcgtaccagcctgatccctcatcagctcaacatcgctcatgatgttggtcgccgccacgcgccgcgcgtcctgctggctgacgaagtgggtttagggaaaaccattgaagccgggatgatcctgcatcagcaactgctctctggcgctgctgaacgtgtgctgattatcgtcccggaaaccttacagcatcagtggctggtagaaatgctgcgccgtttcaacctgcgctttgctctgtttgatgatgagcgttatgccgaagctcagcacgatgcttacaacccgttcgataccgaacaactggtgatttgctcgctggattttgcccgtcgtagcaaacagcgtctggaacatctctgtgaagccgagtgggacctgctggtggtcgatgaagcccatcatctggtgtggagcgaagatgcgccgagccgcgaatatcaggccattgaacaactggcagagcacgtgccgggcgttctgctgctgaccgcaaccccggaacagctggggatggaaagccacttcgcccgtctgcgtctgctggacccgaaccgtttccacgatttcgcgcagttcgttgaagagcagaaaaattatcgtccggttgcggacgccgttgccatgctgctggcaggtaacaagctgagcaatgacgaactgaacatgcttggcgaaatgatcggcgagcaggatatcgagccgctgttacaagcagcaaacagcgacagcgaagatgcccagagcgcccgtcaggagctggtttcgatgctgatggatcgccacggcaccagccgcgtgctgttccgtaacacccgtaacggtgtgaaaggcttcccgaaacgcgagctgcacaccattaagctgccgctgccgacgcagtatcagacggctattaaagtctccggcattatgggcgcacgcaaaagtgcggaagatcgcgctcgcgatatgctctacccggagcgtatttatcaggaatttgaaggtgataacgccacctggtggaacttcgatccgcgcgttgagtggctgatgggctacctgaccagccatcgctctcagaaagtgctggtgatctgcgccaaagccgctaccgcgctgcaactggagcaggtactgcgcgagcgtgaaggtattcgcgccgcggtgttccacgaaggtatgtcgattattgaacgtgaccgcgctgccgcctggtttgccgaagaagacaccggcgcgcaggtactgctgtgctcggaaatcggttctgaaggacgtaacttccagttcgccagccacatggtaatgtttgacctgccattcaacccggatctgctggagcagcgtattggtcgtctggatcgtatcggtcaggcgcacgatattcagatccatgtgccttatctggagaaaaccgctcagtcggtgctggtgcgctggtatcacgaaggtctggatgcattcgagcacacctgcccgaccggacgcactatttacgatagcgtatacaacgatctgattaactatctggcttcaccggatcaaaccgaaggctttgacgatctgatcaaaaactgccgcgagcaacatgaagcgctgaaagcacaactggaacagggtcgtgaccgcctgctggaaatccactccaacggtggcgaaaaagcccaggcgctggcagaaagcattgaagagcaggatgacgataccaacctgatcgccttcgccatgaacctgttcgatattatcggtatcaatcaggacgatcgcggcgacaacatgatcgtgctgacgccgtccgatcatatgctggtgccggacttccctggcctgtcggaagatggcatcaccatcacctttgatcgtgaagtggcgctggcgcgtgaagatgcgcagtttattacctgggagcatccgctgatccgcaacggtctggatctgatcctttctggcgataccggtagcagcacgatttcactgttgaaaaacaaagcgttgccggtaggtacgctgttggtggaactgatttacgtggtcgaagcccaggctccgaagcagttgcagctcaaccgcttcctgccaccgacgccggtacgtatgctgctggataaaaacggcaacaacctggcggcgcaggtggagtttgaaacctttaaccgtcagcttaacgcggttaaccgtcacaccggcagcaaactggttaacgccgtgcagcaggatgttcacgctatccttcagttgggtgaagcgcagatcgagaaatctgcccgtgcactgattgatgccgcacgtaacgaagccgacgaaaaactgtctgccgagctgtctcgtctggaagctctgcgtgcagtgaacccgaacattcgtgacgacgaactgaccgccattgagagcaaccgtcagcaggtaatggaaagcctggatcaggcaggctggcgtctggatgccctgcgtttgatcgttgtaacgcatcagtaacggagccgaaaatggggatggaaaactacaatccaccgcaggaaccctggttggttatcctgtatcaggatgaccatattatggtggtcaacaagccgagcggtttgttgtctgtgccgggtcgtctggaagagcacaaagacagcgtgatgacgcgcattcagcgtgattatccgcaggcagaatcggtgcatcgtctggatatggctaccagtggcgtgattgtagtggcgctgaccaaagccgcggagcgggagttaaaacgccagttccgcgagcgcgagccaaaaaagcagtatgtggcccgcgtctgggggcatccatcccctgcggaaggtctggtggatttgccgctgatttgcgactggccaaaccgcccgaaacagaaagtctgttacgaaacgggtaaacctgcgcagacggagtatgaagtggtggagtatgcggcggataacacggcaagagtggtgttaaaaccgattaccgggcgttcgcatcaattgcgtgtgcatatgctggcgctgggtcatccgattctcggcgatcgtttttatgcatcaccagaagcgagagcgatggcaccacgtttattgctacatgcagagatgctgacgattacccatccggcgtatggcaatagcatgacgtttaaagcgccagcggatttttaacctttcctgtacgtttataccctcatcctaagggctgcctcttgtacataaatccccgagtccggggattttttgtttctgccaaactgctttcagttgttgcgtgtggctacgctttccattcggtaattcccttcctgctccacagcgaatttttgaactttttcttcacccgttgatcgtctctattatttcattttatcgggtctgttatggtcctttctgattgttattcatgggctaattagcagtctggttggcgatgcccatctcggtaatccgcgtcgtgcacgacgccttgcatcaccagcctcttctctagctcatcatgcaggtctttctaattgtgaaatcatcccacgctactgctaaggttgaaggggcgttccagccccttcaaccttagcttattctggatcattcaataattgcgttggcaataatttttcagcagtactttgtttagtggtaatttcttcagtagcaatttttttggtggtgattttattaataataattgcgtcagtaccgtccaggatagcaccttccaggttagcaccgtccaggttagcattccacccaggttccaagtaaagggatttatcgttacctttcattatgttgggaccaaggtaacaattcctcatgtcaacgccgggaaggtaagcctttctaagatcaacgcccaagctaccgaggcccttgcacagcttcaacgtctgagtacatatctcatttttttcaattaaaaaagtgacacttaactcaatatcaccgtagatctgagtgtcccagcacatattagcctttgcgaccatctcatccggattttttgcgcatgttttgagtttattgaataattccaggctattgataaacttttctctctcattctcgtcgatagccccagtaaagtattctgaggcgttgatgttgccaaccttgttattcacgaaattgaacagaagtgtataagcctcaggctgtttatctgaccagaacagatgacgtaacgtctcccacaagcgttgaaagatattcatcttcacgtctatcttgtccccgctcaccatcttataaatatcgttattgctcatatttaaaagtgtagccggcatgcctggaactgatactttcatggtaatagcctcgcattgagttaaaaactcatcatgcgcactctgaataaatatactttcaaaaatcgctcattcagatatgtgttttttatttttaagacgtaaaaatataattccgctcgtcgtaaagctctcaaccttaagcagggtcaacgcgataaaaccaacagaacccctcccgtaaaccgtgcattgagcctgtccaccattctgagtaaacaccttttctcaaagaagtgaccgccagggcggccacctttaatcgtgggcagttactcagcatcatttacagggtcatttaaaccctttctgctgcttaatcagctcataggcctgctgaatttcctgcgctttctgcttcgccatctccatcatctcaggcggcaaacctttcgccaccaacttatcgggatggtgttcactcatcagcttacggtaggcacgtttgatggtggtcgcatcatccgtcggcttcacgcccagcacattacaggcatcttccagcgtcgggccacgctgcgcttgctgccagttaccaccgccagattgctgctgataaccgccgccaaactgtgcaccgccctgcatcatgcgcaaaaactggtcaaactgggcgcgggagatccctaattcttcagcaatgacatacagcaccgcccgttcattcgggtgcagtgaaccatcagcaaacgccgcctgaatctggatctccagaaacatacgaattaagtcaaaacgaccaaagcagacactgcgaaactggcgcatcttttcgcgcagcgggtaattgtctgattttcccacccggaacgcgttttgcgccgcagtacgggaagcgccatgcaggttcattcggtccatcaactggctggcgatatgaatatcagcctccgtgacgcgacctttggatttggttaaatgccccatcacttcaaaagtggtggcaaaaaacagcgcctgacgctcacgctggttggcgaaccacgccattttacggctacgggctttatcaaacatatggccaattaacaggcctaacactacgccccaaaagccgccgcccatcagtaaggccacggccacgccaatgatttttccccaatactgcatatattccccaaatcgacacacggatatcagggctatctcccacaatataaaggtgcttttaccgttttccggctgcggtcaattgtgggacatcgcctataatttgcattatcatacctgtcattcaatgccgtgcctaacaccactgacgctattcggacaggattaacactagcgtagagatgacgagtacgttagtctctgaccgtttgtcacgcgcaacgttaccgatgatggaacaataaaatcaacgtatgaaaaaacgtatccccactctcctggccaccatgattgccaccgccctttatagtcaacagggactggcagccgacctcgcctcacagtgcatgttgggcgtgccaagctatgaccgtcctctggtacagggcgataccaatgacttacccgtgactatcaatgctgaccacgcgaaaggggactacccggatgacgccgtgtttactggcagcgtggatatcatgcagggtaacagccgtctgcaggccgacgaagtgcagctccatcaaaaagaggcaccaggacaaccggagccggtacgtaccgttgatgcgctcggtaatgtccattacgacgataaccaggtgatcctcaaagggccgaaaggctgggcgaatctgaacaccaaagataccaatgtctgggaaggtgattaccagatggtgggtcgtcagggccgcggtaaagcggacctgatgaaacaacgtggcgaaaaccgctataccattctggataacggtagctttacctcctgtctgccgggttctgacacctggagcgtggtaggtagcgaaattattcatgaccgcgaagaacaagttgcggagatctggaacgcccgctttaaggtgggtccggtaccgatcttttatagcccctatttgcagttgccggtgggtgacaaacgtcgctctggtttcttgatcccgaacgctaagtacaccactaccaactactttgagttctaccttccatattactggaacatcgcgccaaatatggatgccaccatcacgccgcattatatgcatcgtcgtggcaatatcatgtgggagaacgaattccgctacctctcccaggcgggcgctggcttgatggaactggactatctgccttcagataaagtctatgaagatgaacacccgaacgatgacagttcacgtcgttggttattctactggaaccactccggggtcatggatcaggtgtggcgtttcaacgtcgactacaccaaggtcagcgatcctagctacttcaatgatttcgataacaagtacggttccagtactgacggctacgcaacgcaaaaattcagcgttggctatgcggtgcaaaacttcaatgccaccgtttcaaccaagcagttccaggtcttcagcgagcagaacaccagtagctactcggcagagccgcagttagacgttaactactaccagaatgatgttggtccgtttgatacgcgtatttacggccaggcagtgcactttgttaacaccagagacgacatgcctgaagcaacccgtgttcacctggaaccgaccatcaatttgccgctctctaataactggggcagcatcaataccgaagcgaagttgctggcaacccattatcagcaaactaatcttgactggtataactccagaaacacaaccaagctggacgaatccgttaaccgcgtaatgccgcaatttaaagttgacggcaaaatggtcttcgaacgtgatatggaaatgctggctccgggttatacccaaacgctggaaccgcgcgcgcagtatttatacgtgccgtatcgcgatcagagcgacatctataactacgactcgtctctgctgcaatctgactactctggcctgttccgggaccggacttacggcggtcttgaccgtattgcctccgctaaccaggtgacgaccggtgtcacatctcgcatatatgatgatgctgccgttgaacgttttaatatttccgttggtcaaatctactatttcacggagtctcgcactggcgatgacaacataacatgggagaatgacgacaaaacgggctcactggtgtgggcaggcgatacttactggcgtatctccgagcgttggggattgcgtggcgggattcagtacgatacacgtctggataacgtagcgaccagtaactccagcattgaataccgtcgggatgaagaccgtctggtacagctgaactaccgttacgccagcccggaatatattcaggctacgctgcctaagtactattccacggctgagcaatataagaatggtatttcgcaggtaggtgccgtcgccagctggccaattgccgatcgttggtcaattgttggggcctactactacgacaccaatgcgaacaagcaagccgactctatgttaggtgtgcaatacagctcctgctgctatgcaattcgcgtcggttacgagcggaagctgaacggttgggataacgataaacaacatgcggtatatgacaacgcaatcggctttaacatcgaacttcgcggcctgagctccaactacggtctgggtacgcaagagatgctgcgttcgaacattctgccgtatcaaaacactttgtgatttgttgatttaccacgtaatccgcagtgcggttaattgaaatggaaaaagtatgaagaactggaaaacgctgcttctcggtatcgccatgatcgcgaataccagtttcgctgccccccaggtagtcgataaagtcgcagccgtcgtcaataacggcgtcgtgctggaaagcgacgttgatggattaatgcagtcggtaaaactgaacgctgctcaggcaaggcagcaacttcctgatgacgcgacgctgcgccaccaaatcatggaacgtttgatcatggatcaaatcatcctgcagatggggcagaaaatgggagtgaaaatctccgatgagcagctggatcaggcgattgctaacatcgcgaaacagaacaacatgacgctggatcagatgcgcagccgtctggcttacgatggtctgaactacaacacctatcgtaaccagatccgcaaagagatgattatctctgaagtgcgtaacaacgaggtgcgtcgtcgcatcaccatcctgccgcaggaagtcgaatccctggcgcagcaggtgggtaaccaaaacgacgccagcactgagctgaacctgagccacatcctgatcccgctgccggaaaacccgacttctgatcaagtgaacgaagcggaaagccaggcgcgtgccattgtcgatcaggcgcgtaacggcgctgatttcggtaagctggcgattgctcattctgccgaccagcaggcactgaacggcggccagatgggctggggccgtattcaggagttgccggggatcttcgcccaggcattaagcaccgcgaagaaaggcgacattgttggcccaattcgttccggcgttggcttccatattctgaaagttaacgacctgcgcggcgaaagcaaaaatatctcggtgaccgaagttcatgctcgccatattctgctgaaaccgtcgccgatcatgactgacgaacaggcccgcgtgaaactggaacagattgctgccgatatcaagagtggtaaaacgacttttgctgccgcagcgaaagagttctctcaggatccaggctctgctaaccagggcggtgatctcggctgggctacaccagatattttcgatccggccttccgtgacgccctgacccgcctgaacaaaggtcaaatgagtgcaccggttcactcttcattcggctggcatttaatcgaactgctggatacccgtaatgtcgataaaaccgacgcggcacagaaagatcgtgcgtaccgcatgctgatgaaccgtaagttctcggaagaagcagcaagctggatgcaggaacaacgtgccagcgcctacgttaaaatcctgagcaactaatggttaaaacccaacgtgttgtgatcactcccggcgagcccgccgggattggcccggacttagttgtccagcttgcacagcgtgagtggccggtcgaactggttgtttgtgccgatgccactctccttaccaaccgggcagcgatgctcggtttgccgctcaccctccgcccttattcccccaactcccctgcacaaccgcaaactgcgggcacattaacgctacttcctgtcgcgctacgtgaatctgtcactgcggggcagttagcggttgaaaatgggcattatgtggtggaaacgctggcgcgagcgtgtgatggctgtctgaacggtgaatttgctgcgctgatcacaggccccgtgcataaaggcgtcattaacgacgcaggcattccgtttaccggtcataccgagtttttcgaagagcgttcgcaggcgaaaaaagtggtgatgatgctggcgaccgaagaacttcgcgtggcgctggcaacgacgcatttaccgctgcgcgatatcgcagatgctatcacccctgcgcttttgcacgaagtgattgctattttgcatcacgatttgcggaccaaatttggtattgccgaaccgcgcattctggtctgcgggctgaatccgcacgcgggcgaaggcggtcatatgggtacggaagagatagacaccattattccggtgctcgacgagctgcgggcgcaggggatgaaactcaacgggccgctgcctgccgataccctgtttcagccgaaatatctcgataacgccgacgccgtgctggcgatgtaccacgatcagggtcttcccgtgctaaaataccagggcttcgggcgcggtgtgaacattacgctgggcctgccctttattcgcacatcagtggaccacggcaccgcgcttgaactggcgggacgtggcaaagccgatgtcggcagttttattacggcgcttaatctcgccatcaaaatgattgttaacacccaatgaataatcgagtccaccagggccacttagcccgtaaacgcttcgggcaaaactttctcaacgatcagttcgtgatcgacagcattgtttctgccattaacccgcagaagggccaggcgatggtcgaaatcggccccggtctggcggcattgaccgaaccggtcggcgaacgtctggataagctcacggtcatcgaacttgaccgcgatctggcggcacgtctgcaaacgcatccattcttaggcccgaaactgactatttatcagcaggatgcgatgacctttaactttggtgaactggccgagaaaatgggtcagccgctgcgtgttttcggcaacctgccttataacatctccacgccgttgatgttccatctgtttagctatactgatgccattgccgacatgcactttatgttgcaaaaagaggtggtgaatcgtctggttgcaggaccgaacagcaaagcgtatggtcgattaagcgtcatggcgcaatactattgcaacgtgatcccagtgctggaagtaccgccgtcagcctttacaccaccacccaaagtggattccgccgtcgtgcgcctggttcctcatgcaacgatgcctcacccggttaaagatgttcgcgtgttgagccgcatcaccaccgaagcctttaaccagcgtcgtaaaaccattcgtaacagcctcggcaacctgtttagcgtcgaggtgttaaccggaatggggatcgacccggcgatgcgagcggaaaatatctctgtcgcgcaatattgccagatggcgaactatctggcggagaacgcgcctttgcaggagagttaacgatgatcaattcgccccgagtgtgtattcaggttcaaagcgtctacattgaggcacaatcttcacctgataatgaacgttacgtttttgcttataccgtaaccatacgcaatctggggcgagcgccagtgcagttgttggggcgttactggctgatcaccaatggcaatggccgtgaaaccgaagtccagggcgaaggagtggttggcgtccagccacttatcgcgcctggcgaagagtaccagtacaccagcggtgcaatcattgaaaccccgctgggcaccatgcagggtcactacgaaatgatcgatgaaaatggcgtccctttcagcatcgacattcccgtattccgactcgccgttcccacactcattcattaaaagaatatggcgacataccttattggcgacgttcatggttgttacgatgaactgatcgcattgctgcataaagtagaatttacccctgggaaagataccctctggctgacgggcgatctggtcgcgcgcggcccgggttcgctggatgttctgcgctatgtgaaatccttaggcgacagcgtacgtctggtgctgggcaatcacgatctgcatctgctggcggtatttgccgggatcagccgcaataaaccgaaagatcgcctgacaccgctgctggaagcgccggatgccgacgagctgcttaactggctgcgtcgccagcctctgctgcaaatcgacgaagagaaaaagctggtgatggcccacgccgggatcacgccacagtgggatctgaagaccgccaaagagtgcgcgcgcgatgtagaagcggtgctgtcgagtgactcctatcccttctttcttgatgccatgtacggcgatatgccaaataactggtcaccggaattgcgggggctgggaagactgcggtttatcaccaacgcctttacccgtatgcgtttttgcttcccgaacggtcaactggatatgtacagcaaagaatcgccggaagaggcccctgccccactgaaaccgtggtttgcgattcctggccctgtcgctgaagaatacagcatcgcctttggtcactgggcatcgctggaaggcaaaggtacgccggaaggtatttacgcgctggatactggctgctgctggggtggtacattaacctgcctgcgctgggaagataaacactattttgtccagccgtcgaaccggcataaggatttgggcgaagcggcggcgtcttaaacacagcctgatacaggaaggccggataagacgcgaccggcgtcgcatccggcactagccgtaaattctatacaaacttaccgccgctccagaatctcaaagcaatagctgtgagagttctgcgcatcagcgtcgtggaattcgctgaataccgattcccagtcatccggctcgtaatccgggaaatgggtgtcgccttccacttctgcgtcgatatgcgtcagatacagtttttgcgcttttggcaggaactgctcataaacgcgaccaccgccaatcaccatgatttctggtacgtcaccacacgccgcgatggcttcatccaccgacttcacccacgttacgcgatcgtccgtacccggttgactgctgaggataatatttttgcgtcctggcagcggacgaccgatggattcccaggtatggcggcccataattacgggtttatttaaggtgttgcgtttaaaccaggcgagatcggcaggcaggttccacggcatggcgttttccatgccgataacgcgatctaccgctaacgccgcaatcagactgatcattgagatttcccgataaaaaaaattgtcgccactatacgtaaagcgtaaaccgtcgtcgactggtgcgaggatgatgttgaggaaaattttatattctgctggcgagtccacgctctcccactggactcgccgcattacaatgaaataaaaacaattagttagctgtaaagtgtgatttacgtcactctttattaggatgagggtttcgtttccggttcatccgccatgttgccggtatgtttcccttcttcggttccctgccagccatgtcgttgaattaatgacagatgttcgcggtcttcggtaatgatctcacttaacatcgcgctggtgcgtttatagaccgccgcgcgggctttggtgtcgttctcaaccattgccatctcttctaccatctgaatattaaagcggcggaacacatcggcacgttctcgcgcttcatacggccccagacctaaactttccagtgccagacgcccggttttcagcgcaccttcgaaggtttcacgctccggcttttcaacgcctgcctgacgcaaacgaatgtagtggtcgacatcgcgggcgcgggcaataatctgcaaatgcgggaaatgttctttcaccatctccgtcagttgcaggttggtttgcggatcgtcgatggcgttaatcagcacttccgctttcgccgctccggcagattccagtaaatccatccgcgtggcatcgccataaaacactttcataccaaatttacgcaaggtttcgatatggtccggatcgtgatcgagcaccaccattttcaccccgctcgagagcagtaaacgtccggtgatctgcccaaaacgaccgaatccggcaatgattacccgcggctgttcttcgtcgatctcatcggcttcacgcgcctcttcactagaagattgctcaaggcgattgaggatcaccagcagaatcggcgttgccgccatcgacagcgccaccgccagggtcagcgatttcgcccactccggctccagcacattcgccatctgcgccgcaccaaataccacaaaggcaaactcactaccctgccctaacaacaccgcaaaccagcgacgctgtttatttggcacctgcaacggtcgggcaatcagccacagcatggcgattttgatgatgaggaaaccgagcagcagaatgacaatacgcaatgggttttcaatcagcgtgccaaagtctatcgacatgccaacgccaatgaaaaacagccccagcagcaaacctttaaagggttcgatatcgctttccagcgcatgacgatattccgagcttgccagcagtacgcccgccagaaacgcgcccatcgccatcgacaagccaacctcttccagcagcaaaccaaagccaaacacgaggaataacgccacggcactaaacacttcccgcaagccagagcgggcgacaaagcgcagcgccggacgcgtgacatagcgccccagcagtaccaccagcaccagcgcacccgccacttttaacgccgagagagcaaatgcgcccatcgtcgtcgaggcactgctcgccgccagtagcgggatcatcgccaccagcgggatcgccgcgatatcctggaacagcagcaccgcaaaggcactgcgacccatttgcgtcatcatcagattgcgttcattcatcgcctgcatggcaatcgccgtagaggagagcgccagcgtcatgccgatcaattccgcgacctgccagcgcagcccaagcaacatacagaacagccccagcaggccgccgcaaatcaccatctgcaatgcgccaccaccgaacaccgccgcacgcagcttccacagcctttgtggatcgagttcgaggccgataataaacagcatcagcaccacgccaatctcggcaaagtgcagaatagattcggcatcggtcaccagtcgcagcccccacgggccaataatgcagccagcgatcaggtagccaagtaccgatcccagaccaagacgtaccgcaatgggtacaatcagcgccgccgaaccgagataaatcagcgcctgaatcagcgtatggctatccatgatgtgcctcctgccattccagcagacgttgcttatagtgccgcgcctgcccttcgagggtttcgtcgtcacaaataaaggtgcagtgcatggcaaacggtggcagccagttcagcccgcagtagattgccgtcgcctgtagcggctgtgacagcacatcaaagcccggatgcgcaccaatctcaaaatggctttctccgccgccggtcgtcaccgcccacagcaaatgtttgccatgcagcgccgtaccgccgtgaccgtaagcccagccgtgcgagaaaactttatcgatccaaagtttgaggagcggtggaatgctgtaccactgcatcgggtgctgccagacgatcagatcggcgcgagacagcgcctcctgctcggcggcaatatcgatattgaagtcaggatagagttgataaagagagcgaatttcgacgccttccagcgtccttgcctgttcaagcatccgtttattcgcatgggaatgatgcggatacggatgcgcataaattataagaatcataggtagcccgcgtgattacgcctttgttttcccacaaagtgtagtcatatattcacgcggcttatagtcaataatattgattcagaaaagagagaaatctgaacaaattatcccattctctgcccgcggatcgtcatattgctggtctgcgccagtgacatccctcgagtctccggggcaaacgctacggaaatcaacaagccaaacagcgagatacccgcccccattaacatcgtgttactgataccgtaattattgataaagatcggcagtgcccaggtcgaaacaatagtgccaatacggcttaaggacataatcacgcccacggcagaggcgcggatatccgtcgggaagagctcattaggatagagccactgcaaattacccggcccgccagagaaaaaggcatacaccgcaaatgccatcactaccagccagatccccatatccgggatcagccccaaaaccgccagcgccagcgtcatcatggcaaagctgccaatcaacaatggacgccgtccggcagtgtttaaccacagcatcggtggaatacagccgagcataaagaacaggctaatcaccacgttccccagtgccgcgtttttgccaacacccaatcccaacaaaccaacgatttgcgggccaaaggtgtagatggcgaacatcgggatcacctggcaggtccagatggcggcaacaaacagaacaaaaggaaaatggcggcgattaaacagatcgcgaaaacgggtttgctgcggctgctcttcatcgaaagccaccggttcgccaaacagtttgatcatcatctcttcgcactcttttactcgccctttgcgtaacaaccagcggggagattcaggcagttcgaatcgaccaatcaaaatcaacaaacaggggatcgctgcgctacccagcatccagcgccaaccaccttccacatcataaagccagtaaccgaccagatcggcgcaggtcgcgccgacataccacatcgcggcaataaagctgatggaaaacgcccgctgacgggtactggagaactcagtgatcatcgaagtggcgatgggataatctgcaccgatgacaatgccgatgagtacccgcatcactaacagttcgacgggggatgagacaaacatcgtcgccaccgatatcacgccgatggcgatgatatcgatgaggaacattttgcgccgtccgactttatcggagatatagccaaacagcgatgtgccaacgaacagcccggcgagcgttcccgcgcccagcaagccaatccagtcagcgtccagtttcagcgccggcgtcagttgctccagcgccacgccaatcattaccagtacataaccatccagaaacggaccaccgcttccccacagcaaaatgcggcggtgaatagaagagaatttaagatcgtcaaagtttctggacggttgcatgggttattcctgtttttttgcaatgagagtcagtacggcgttacgtatcaaaccaacatcagccgtaacggaactccacaccaaaggtgccgcgcgggtattcccactgttccagcgccgaccccagccccagaatgcgacaggtgccgcactccagacatccggcgtaatcgaagcgcacactgccgtcatcctgcttcttgtacagacctgcggggcacgctttcaccagcagctccagcgcctgtttatcggcatcggccttcacaacaatgtgcggatgctcttcatcgacattgaatttattgacgcccagtttgacgtccacattgacgggagaagtcataaaacggtcactcctttcatgccatccttgatcagattgatgaagcccactttcttaccgtggcggaggattttcttgcgcatcagttccggcacgctgccgtcaatggtgaacaggtcacgcgccacgcccaccgccagttccgggtagccgctaaacatgcgtgggttatcaaggaacgccggtagtttctggtacatacgcatatcgcgcagcgggccactctcaagatgctgacgatattccgccagtttttgcttactgaaatcgtcgcttttcatcgctgaaagcacggtttttgctgcggcttccccggcggcaatcgccagatccataccgcgaatggtaaaaccgaggttcatacacattccggcggcatcaccggcaatcagtacgccgtcaccgaccagctccggcagcatgttgatgcctgcttccggcactacgtgagcggaatattccaccagcttgccgcccgcgatcagcggtgcaacggccggatgttgtttgaaatcttccagcatttgcggcaccgatttttttgcgtcatgcagatgatggagaccacaaaccagccccagcgacagggtattttcattggtataaaggaagccgccgcccatcaggccatcggtgggggaacccgcaaacaggcaagccgcaccctgattaccctgcaactgaaaacggtcttcgataaccgacttcggtaactcgatcagttccttcacgccaaccgccacatccgtcggtttgacgcgttttgccatccccaacttttcggcaaggatggagttcactccatcagcaaggatcaccgttttcgcttcaatcacatcaccatcggcttctacgccgacaactttgccatcgcgctgtacgaggttatcgacgcggatcccggtaattaactgcgcgcccgcttcttcggcctgctccatcagccaggcatcaaatttactgcgcaaaacggagtaagaacgctgggatggcgaggtttcgtcgccattgcagtagtccatagtcatcgctgacttttccgtcataaacgcgagtttttcatgggtgatcaggcgttctacgggggcggattcggcgaaacctggaataatgtgttccagactgtgggcatagagacgcccgccagtaacgttcttggcacctgcggaattgccacgctcgataactaacacttgcgccccttcgcgggcgagcaccagtgcggcaaccgaaccggcaagcccagcaccgacgatgatggcgtcaaagatatcttcggacataagagctccctgtcagcggcagggccgtaatgcagccctgccagagtggatcaacgcgctaaagctgcggtcagtgccggaaggatcttcacggcgtcgccaacaataccgtaatccgcgtactggaagatcggcgcatttttatctttgttgatggcgaaaatggtttgcgacgcattagcaccaaccatgtgctggatctgcccggagatccccaccgccaggtacagttcaggtttcagcatcaggttggagataccgacatagcgttcgtgctccatccatttttcgttttccgccaccggacgagaacaggccaactccgcacctatcgccttacaaagctgttctgccagcgcaatgttatctttgctgccaatgccgcgaccgacgctgaccaccagacgggctttgtcgagatcgacgctgttgctctggcgcgcctgggttgccgtgcgggtaatcgccacagccggagcctgccactccacggtgtgcgtttcgccagtgcgtgacgcgtctggctgagccgcatcaaacgtgccgctgctgatggtcagtaccgcatacggcgtggcaatgcgttcttcgccaatcgccagaccgccgtaaaccatgtgtttcactgtcgctttaccgtcctgtacgctgacggtgctggcatcgttagacaccgccgctttaaggcgataacccagttttgccgccagtaatttgccgcgacgagtattcggcaacagcaccagaccgtctgctccgtgctggcgaatagtgtcagccatgacaccggcgtaatcttcgatcatccgatcgtccggtttgccgtttaatttccagacatgattagcgcctagctggattgcctgtgcgccgtcggcatcattgaggacaaaggcattgatttgattagctaaagcctgcgcaccgttcatcagttccggcagacgagaaggggtatcgctgaatacccagacttgagaaaacgtgttcatagcatcccctgtaattaaatgactttgcgaagattttcagcaaatgcggcgatctgttcttcgccgtcgccttcaatcacgatgcgctgacgctcgcgctgtttcggcgcggcaacctgttgttctgaccaggctgcctctgcgttaaaaccgatatccgccgccgaccatacctggactggctttttcgccgcgccgagaatggctttcatcgaaggaatttgtggggagttgatatcagtggaaacagcaacaaccgcaggcagcggaatgcttaaggtttctgtttcatcttccagttcgcgctcaacggtgagggtatctgccgtcagggagataattttgctgacgccgttaactgccggaatattgaggatttcgcctaccagcaaaccaacctgctgggcataaaggtcggaagaaccatcgccacagaggatcaaatcaaagcctgctttctgggcggcagcagccagtgcggtcgctgtttgttgcggcagtgcccgctcgaactggtcatcaatcaccacaatcagttcatccgggccgcgcgatagcacatctttacgccctttggcgttggtcagggctttaccgcccacacttagggccgtcacctgcgcctctgctgcctgttgctttagctggcaagccgcttcaatagcgttgagatcgtattggcttattttggcatcggctttactgaagtctaacgaaccatcagcattattgaccgcaatatcctgttcatcaggcacgcacttatagcaagtaataatcttcattgcatctccagaaatcatgaaggaaacgtcgttcatatcggtggtgttaattacagatatcacgccctttaatttggaaataaaactttaatcaccaatattgaaaatgtcacacgcagataaatccaactttcaatattgttaagtccctcaccaatattgaaaacatggcgtagcaaaaagaaattttcaatattgctttatggatcaccaatattgaaagtcagatgctatttttttactcacaatcaaactcatcacattgataaacaatgaatatttacacaaagacgccctgtttttacccgataaaaaactgtgactaacatcacagaacgcagccaattgaatacccattatgagttagccattaacgcgtccacgaggttaataataattatattaaatgttaacaaaaataaaacaaacgggaacgcaaaataaatattcgttttcacagtggaattaactcatgaagaatgaaaagagaaaaacgggaatagaaccgaaggttttctttccgccgttaataatcgtcggcatactttgttggcttacagtcagagatctggatgcggcgaatgtcgttattaatgctgtattcagttacgtcaccaatgtatggggatgggcatttgaatggtatatggtggtgatgcttttcggttggttctggctggtgtttggcccgtatgccaaaaagcgtttaggtaacgaaccaccagaatttagtaccgccagttggatctttatgatgttcgcctcctgtacgtctgctgccgtactgttctggggatcgattgagatctactactacatctccaccccgccgtttggcttagaaccgaactcgacaggggcgaaagagttggggctggcttacagcttgttccactggggacctctgccgtgggccacttatagcttcctttctgtcgccttcgcttacttcttctttgtccgcaaaatggaagtgattcgccccagctccaccctggtgccgctggtgggtgaaaaacacgccaaagggttgttcggtaccatcgtcgacaacttctatctcgtcgccttgattttcgcgatgggtaccagtctgggccttgccacgccgctggtgaccgagtgtatgcaatggttgtttggcattccgcataccctccaactggacgctatcatcattacctgctggattatcctcaacgccatttgcgtcgcctgcggtctgcaaaaaggggtacgtatcgccagtgacgtgcgtagttacctgagcttcctgatgctgggttgggtgttcattgtcagcggtgccagcttcatcatgaactacttcaccgattcggtggggatgttgctgatgtatctgccgcgcatgttgttctataccgatcccatcgctaaaggcggcttcccgcagggctggaccgtgttctactgggcatggtgggtgatttacgctatccagatgagtatcttcctcgcccgcatctcccgtggtcgtaccgtgcgtgaactgtgcttcggcatggtgctggggctgacagcgtcaacctggatcctgtggactgtactcggtagtaacactctgctgttgatagataaaaacatcatcaacattccaaatctgatcgaacagtacggtgtggcgcgcgccatcattgaaacctgggccgctctgccactcagcaccgccaccatgtggggcttcttcatcctctgctttattgccaccgttacgctggttaacgcctgctcttataccctggcgatgtccacttgccgcgaagtacgcgatggtgaagaaccaccgctgctggtgcgtatcggctggtcaattctggttggcattatcggtattgttctgctggcgctcggcggcctgaaaccgattcaaaccgccattatcgccggaggatgcccgctgttcttcgtcaacattatggtgacgctctcctttattaaagacgcgaaacagaactggaaagattaattaacccccaaaatatcaagaggttgaaagatggattttaatttaaatgatgagcaggaactgtttgtcgccggtatccgcgaacttatggccagcgaaaactgggaggcctattttgccgagtgcgaccgtgacagcgtctacccggaacgttttgtcaaagcactggcggatatggggatcgacagtctgctgatccctgaagagcacggtggtctggacgcggggtttgttactctcgccgccgtgtggatggagctgggacgtctgggggcaccaacctatgtactgtaccagttgccgggcgggttcaacaccttcctgcgcgaaggcacacaagagcagatcgacaagattatggctttccgcggcaccggtaagcagatgtggaactcagcgattaccgaaccgggcgcgggctccgacgtgggtagcctgaaaacgacttatacccgtagaaatggtaagatttatcttaatggtagtaagtgttttattaccagcagcgcctacaccccgtacatcgttgtgatggcgcgcgacggggcttctccggacaaacctgtctacaccgaatggtttgttgatatgagcaaaccgggcatcaaagtgaccaaacttgaaaagctcggtctgcgtatggatagctgctgtgaaatcacctttgacgacgtggaactggacgagaaagacatgttcggtcgggaaggtaacggctttaaccgcgtcaaagaagagttcgaccatgaacgtttcctggtagccctgaccaactacggtacggcgatgtgcgcctttgaagatgcggcgcgctacgccaaccagcgcgtgcagtttggcgaggctattggtcgtttccagttgattcaggaaaaattcgcccacatggcgatcaaattaaactccatgaaaaacatgctgtatgaagcagcgtggaaagcagacaacggcaccatcacctctggcgatgcagcgatgtgcaaatacttctgcgccaatgcggcatttgaagtggtggatagcgcaatgcaggtgctgggcggtgtcgggattgcgggcaaccaccgcatcagccgcttctggcgtgatctgcgtgtagaccgcgtctccgggggatctgacgaaatgcagatcctgacgctgggtcgcgcggtgctgaagcaataccgctaagtccgtgcgctgcctgatgcgacgctgacgcgtcttatcagacctacgggagcacgaatgtaggccggataaagcgtttacgccgcatccggcagtcatgcgctacataaatttttcaggagctaataatggatcatctacccatgccgaaattcggaccgctggccggattgcgcgttgtcttctccggtatcgaaatcgccggaccgtttgccgggcaaatgttcgcagaatggggtgcggaagttatctggatcgagaacgtcgcctgggccgacaccattcgcgttcaaccgaactacccgcagctctcccgccgcaatttgcacgcgctgtcgttaaatattttcaaagatgaaggccgcgaagcgtttctgaaattaatggaaaccaccgatatcttcatcgaagccagcaaaggtccggcctttgcccgtcgtggcattaccgatgaagtcctgtggcagcacaacccgaaactggttatcgctcacctgtccggttttggtcagtacggcaccgaggagtacaccaatcttccggcctataacaccatcgcccaggccttcagtggttacctgattcagaacggtgatgttgaccagccaatgcctgctttcccgtataccgccgattacttttctggcctgaccgccaccacggcggcgctggcagcactgcataaagcgcgtgaaaccggtaaaggcgaaagtatcgacatcgccatgtatgaagtgatgctgcgtatgggccagtacttcatgatggattacttcaatggcggcgaaatgtgcccgcgcatgaccaaaggtaaagatccctactacgccggttgcggtctgtacaaatgcgccgacggctacatcgtgatggaactggtgggcattactcaaattgaagagtgctttaaagatattggcctcgcgcacctgcttggtacgccggaaatcccggaaggcactcagcttatccaccgtatcgaatgcccttacggcccactggtagaagagaaactcgatgcctggctggcggcacataccatcgcagaagttaaagaacgctttgccgaactgaatatcgcctgtgccaaagtactgaccgtaccggaactggaaagcaatccacaatatgtggctcgcgaatcaatcactcagtggcaaacgatggatggtcgcacctgcaaagggccgaacgtgatgcctaaattcaaaaataaccccggacaaatctggcgcggaatgccctcacatggcatggacacggctgccattttgaaaaatatcggctacagcgaaaacgacattcaggagttggtcagtaaaggtctggccaaagttgaggactaaacgcgtggcgtcagtcggcttgcctgactagcgcccgcccaataacaaacgaacaacaatggatagaggtgcaatggatatcattggcggacaacatctacgtcaaatgtgggacgatctggcggacgtttacggtcataaaacggcgctgatttgtgaatccagcagcggagtcgttaaccggtatagttatcttgagttaaatcaggagattaaccgcacggcaaacctgttttatacgctggggattcgcaaaggcgacaaggttgctctacatctcgacaactgcccggaatttatcttttgctggttcgggctggcaaaaattggcgcgattatggtgccgattaacgcccgcctgttacgcgaggaaagcgcgtggatcctgcaaaatagccaggcgtgcctgctggtgaccagtgcgcaattttatcctatgtatcaacagattcagcaggaagatgcctctcagttgcggcacatttgcctgatagatatggcacttcccgctgatgatggcgtgagttcgtttactcaactgaaaaatcaacaacctgccaccttgtgctatgcaccgccgctatcgactgacgatacggcggaaattctcttcacctccggcaccacctcccgaccgaaaggtgtggtgattacccattacaacctgcgcttcgctggatattactccgcctggcaatgtgcactgcgtgacgatgacgtctacctgacggtaatgcctgcgtttcatattgactgccagtgtactgcggcgatggcggcgttttctgccggggccacctttgtgctggtcgagaaatacagcgcccgcgccttctggggacaggtgcagaagtaccgcgccaccattaccgaatgtattccgatgatgattcgtacgttgatggtccagccgccttcagccaacgatcggcaacactgcctgcgggaagtgatgttttatctcaacctgtcggagcaggaaaaagacgcgttttgtgaacgcttcagcgttcgcttgctgacgtcttatgggatgacggaaaccattgtgggcattatcggcgatcgccctggcgataaacgacgctggccgtcgattggtcgggcgggcttttgctacgaagcggagatccgcgacgatcacaatcgtcccctcccggctggtgagctcggtgaaatctgtattaaaggcgtaccagggaaaaccatcttcaaagagtattttctcaacccgaaagccactgcgaaagtgctggaagccgatggctggctacataccggcgataccggataccgcgacgaagagggctttttttatttcgtcgatcgccgctgcaatatgatcaaacgcggtggcgagaatgtctcctgcgtggagctggaaaatattatcgccgcgcacccgaaaattcaggacatcgtggttgtgggtattaaagattcgatacgcgatgaagccatcaaagcatttgtggtgctgaatgaaggtgaaacattgagcgaagaggaatttttccgcttctgcgaacaaaatatggcgaaatttaaagtgccctcttatctggagatcagaaaagatctgccacgtaattgctcggggaaaataattagaaagaatcttaaataaatgaaacggcagggaactaccctgccagctaataatcacgctctaaaataatatgcattttttgcagagatgttgtcgtccctgaaaaagcaaaaatggagaaaaggaatgagtgaatcattacatctgacccgcaatggatcaattctggaaattacccttgatcgcccaaaagcgaatgctattgatgcaaaaaccagctttgaaatgggcgaagtatttctaaatttccgtgacgatccgcaattacgtgtcgccattattaccggtgccggagagaaattcttttccgcgggctgggatttaaaagcggcagcagaaggcgaagcaccggatgctgactttggcccgggtggttttgcgggattaaccgaaattttcaatctcgacaaaccagttatcgccgctgtgaacggctatgcctttggcggcggctttgaactggcactggcggcagattttattgtctgtgccgataacgccagcttcgccctgccggaagccaaactgggcatcgttcctgacagcggcggcgtgctgcgtctgccgaagatcctgccgcctgccatcgtcaatgaaatggtgatgaccggcagacgaatgggcgcagaagaggcgctgcgttggggggtagtcaaccgcgtggttagccaggcggaactgatggataacgcccgcgaactggcgcagcagctggttaacagcgctccgctggcgattgcggcgctgaaagagatctaccgcaccaccagcgaaatgccggtagaagaagcgtatcgctatattcgcagcggcgtgttgaaacactatccgtcggttctgcattcggaagatgccattgaagggccgctggcgtttgccgagaagcgcgatccggtgtggaaaggacgttaacaaccgtgagctattacgcctttgaggggttaattccggtggttcacccgacggcgtttgtccatcccagtgcagtcttgattggcgatgtgattgtgggagccggtgtctacatcggcccactcgcctcactgcgtggtgactacgggcggttgatcgtgcaagcgggagccaatattcaggatggctgcattatgcatggctactgcgacactgacaccatcgttggggaaaacggccatatcgggcacggagcgatcctgcatggttgtgtgattggtcgcgatgcattggtcgggatgaacagcgtgattatggatggcgcggtcattggcgaagagagcattgttgccgccatgagctttgtcaaagcgggctttcgcggcgagaaacgccagttgttgatgggtacgccagcccgcgctgtacgcagcgtgagtgacgacgagttacactggaaacggttgaataccaaagagtatcaggatcttgtcgggcgctgtcatgcatcgttacatgaaacgcagccactgaggcaaatggaggaaaatcgcccccgtttgcaggggacgacggatgtgatgccgaaacggtgatctttccggatgcggcgtaaacgccttatccgacctggctggaaagcaatcgtaggccaggtaatgatttacagcggcaagttttacttcaaatgaatgtttcataaactgcaccttcagatgtcagattatgtccaacatttggggtgcagttcagccagcatcgcatccggcgatcaggtcgcacggtatcaacgaaatgacattaacgacgcatactctttgacaacatcatctgccacttctgctcgcggttaagttccgtgagcggaacggcaggaatacgcggcgtctttcttacgccgactaatttttcccgactgttattgcgcaggcgcgcgtaaatttgctcatcgatatcgaccactttaaccagtcgctgacactggcatccccgcccttccagcttattagggatcatcttaacttcgcagcttatttctgtgacttccgacagaatataagtcagggtattaaccgccttgctgtgttcaatatcgaaatgaatagagatctctcttgctatcacccaccgattttcagccatcatccattcggcgattaacaagtagagtggtttttcaacatatccttcacacatacgaactccagtttcacaaattaaaagtctggctatgactcgttttgaagcaattaaacaaggccatattaaaattgtggatatatcgatagtatgcaacttcaccgtcgataagtgtgagctaaatcctgcttatgtcatcaaaaatatcgattccccaaaagatttacttaatgggcaaaaaaaacggtcctcatcagagaaccgtattagttattcgatcaaattagcggatgaaaaatatccgccatgacacgctattatttgatctgcgcgtgcatttcctgcaccgaaattactttttcagtcgcatcggcattcagcgccatcgcggtagcgaaaccaccgttcagggtggtgtcataatgcactttatattgcagcgcactgcgacggatcacgcgggagtcttcaatcgcacgacggcctgaggtggtgttgatgatgtaggtatattcgccattcttgatacggtcctgaatgtgcggacgaccttcatgcaccttgttcaccagacgcggattaatgcctgcttcgcccagcacaatcgccgtgccgtgggtcgcatccagctcgaagccctgtttcagcagttttgccgccaggtccaccacgcgttctttgtcgccttcgcgcacggaaagcagcgcacgaccgtgtttcttcatggtggagttgctgcccagctgcgctttggcgaacgcttcagcgaaggtgcggcccacgcccatgacttccccggtagagcgcatttctggccctaacagcgggtcaacgcccgggaatttattgaacggcagcaccacttctttcaccgagtagtacggagggataacttctttggttacgccctgctcggccagcgttttgcctgccatcacgcgcgccgccactttcgccagcggtacgccggtggctttggagacgaacggaacggtacgcgctgcacgcgggttaacttcaatcaggtagacttcgttgtttttcaccgcaaactgcacgttcatcaggccgcgtacctgcaattcgaaggccagtttctgcacctgctggcgcatcacatcctgaatttcctgacttaaggtgtaggctggcagcgaacatgcggagtcaccggagtgcacgcccgcctgctcaatatgctccatgatgccgccaatcagcaccatttcgccgtcgcagatagcatccacgtcaacttctactgcgtcatcaaggaagtggtccagcaacactggcgcatcgttagatacgctgaccgctgtctggaagtagcgacgcaggtcagcttcgtcatagacgatttccatcgcccgaccgccgagaacgtaagacggacgcaccaccagcgggtagccaatctctttcgctttctcaaccgccatttcgatggtggtaacggtggcgttcgccggttgtttcagtttcagacgctcaaccgcatgctggaagcgttcacggtcttccgcacggtcgatggcatccgggctggtaccgataaccggtacgccagcagcttccagcgcgcgcgccagtttcagcggggtctgaccgccgtactggacgataacgcctttcggcttctcaatacgcacaatttccagcacgtcttccagagttaccggctcgaagtagaggcggtcggaagtgtcgtaatcagtggagacggtttccgggttacagttaaccataatggtttcgtaaccgtcttcgcgcagcgccagtgaggcgtgtacgcaacagtagtcgaattcgataccctgaccgatacggttcgggccgccgccgaggaccatgattttttcacggtcagatgggttggattcgcactcttcttcataagtggagtacatataagcggtgtcggtagcgaactctgccgcacaggtatccacgcgcttgtaaaccgggtgcaggtcatactggtcacgcagcttacggatttctgcttcacgcacgcccgcgagttttgccagacgcgcgtcggcaaagcctttgcgtttcaactggcgcaggaagtcagcgttcaggccagtgatgcccacttccgccactttctcttccagacgcaccagctcttcaatctgtaccaggaaccagcggtcaatgttggtcaggttgaagacgccgtctacggacaggcccgcgcggaaagcatcggcgatataccagatacgctctgcgccagcgtctttcagctcgcggcggattttagtcagcgcttccgggtcgtcgagactcactttcggatcgaagccggtcgcgcccacttccaggccgcgcagcgctttttgcagggattcctgctgcgtgcgaccaatcgccatcacttcgccaaccgatttcatctgagtggtcagacggtcgttcgccccggcgaatttctcgaagttgaagcgaggaattttggtgaccacgtagtcgatggacggctcgaaggaggccggagtacgcccgccggtgatgtcgttcatcagctcgtcgagggtgtaacccaccgccagtttcgccgccactttggcaatcgggaaaccagtggctttcgacgccagcgccgaagaacgcgacacgcgcgggttcatttcgataacaatcaggcgaccgtttttcgggttcaccgcaaactggacgttggaaccaccggtttcaacgccgatttcacgcagcaccgccatcgaggcgttacgcatgatttgatattctttgtcggtcagcgtttgggctggtgcgacagtgatggagtcaccggtgtggatgcccattgcatcgaagttttcgatagagcagacgatgatgcagttgtcgtttttatcacgcaccacttccatctcgtactctttccagccgatcagcgactcatcaatcagcagttctttggtcggagagagatccagaccgcgggcgcaaatttcttcaaactcttcgcggttataagcgataccgccaccgctaccacccatggtaaaggatgggcgaataatgcacgggaagcccacgtcagcggcaaccgccagcgcttcttccatcgtgtgtgcgataccggaacgcgcggtttccagaccaattttcttcatcgctacgtcgaaacgacggcggtcttctgctttatcaatcgcatcggcagtggcaccaatcatggtgacgccgaactcttccaacacgccctgacgttccagctccagcgcacagttcagcgccgtctgaccgcccatcgttggcagcaccgcgtccgggcgctctttttcaataatcttgcgtaccacttcccagtgaatcggctcgatgtaggtcgcatcagccatttccgggtcggtcatgatggtcgccgggttggagttcaccagaatgacgcggtaaccctcttcacgcagggctttacacgcttgcgcgccagagtagtcaaactcacacgcctgaccgataacaatcgggcccgcacccagaatcaggatactttttatatctgtacgttttggcatggctcttttactcctgattacttagcggttttacggtactgctcaattaactcgataaagtggtcgaacaacggcgctgcgtcgtgtggcccagggctggcttcagggtgaccctggaagctgaacgccggtttatcggtgcgatgaatgccctgtaacgtaccgtcgaacagggatttatgcgtgacacgcaggtttgcaggtaatgttgcttcatccaccgcaaaaccgtggttctgggcggtgatcatcaccacgtttttctccacatctttaaccggatggttgccgccgtggtgaccaaatttcattttgacagtcttcgcaccgctcgccagcgccagcagctgatgaccgagacagatgccgaagaccggaatatcggtttcgaggaatttctggatggcggtaatggcgtaatcgcacggggccgggtcgccaggaccgttggagaggaagatgccgtctggattcattttcaacacatcttccgcagaagtttgcgccggaacgatggtcaggcggcagcctctatccaccaacatgcgcaggatgttgcgcttggcgccaaaatcataagccacaacatggaacggcagctcgtcttctttcttcgcttctggcaggccgccggtcagcgtccagctcccttgtgtccagctatacgtttctgcggtggtcacttcttttgccagatccatgccgttcagacctgggaacgcgcgggctttttctaatgccagcaccgcatccgggttatcgcctgcgataatgcagccattctgtgcgcctttctcgcgcagtaaacgcgtcagcttacgggtatcgatatcggcaatcgccacgatgttatggcgcttcaggtaagaagagaggtcttcggtattacggaagttgctggcaatcagcggcaggtcgcgaatcaccagaccttgtgcatgtacctgagaagattcttcatcggcgtcattagtgccgacattaccaatatggggataagtaagagtaacgatttgacgagaataggaaggatcagtgaggatttcttgataaccggtcattgaagtattgaaaacgacttccccaaccgccgaacctgttgcccctatggcccgaccgtgaaactgggttccgtcttccagaaccaatagcgctgacttaatcaaaacaccctccagagaatattcactcactttatttgcatattaattcacaatgatgacgtaaatcaatgcaaatctgcttaccgacgaatttctggcaaacggcggcattctggagatatgggcgctaaaagtcaacttaatggcgggattttttatattattttgtggctcatgcatgttttacaggcattaagcgacaaaaagatcatataacatgttctggaaaacgcttgcgcagcaagaagattgcatgaaatcaaaatgagcagaaaaaagtggaccaaatggtcaaaatttacattaaaacaacaaaaacagaatacaaaacatgtaattttcagcacttgcattaaatttaaaagcataacaccaaaaataaaagggccaaaaattaaagccctttatattcaatgcattaaatgtgttatttttgaatcactataaatattttgtggttacagattattgagatcaagcacatctcgcatatcaaaaagaccactttccttaccactcaaccacaaagccgatcttaccgcaccgttagcaaatgtcatgcggctggatgccttatgggtgatctccagacgctcgccaatatcggcaaacatcgcggtatgttcaccaacgatgtcacctgcacgcacggtggcaaaaccaatggtgccaggcacacgttcaccggtatggccttcacgactgtagaccgcgcaatctttcagatctttatcaagagcgtgggcgatcgcctctcccattgccagtgcggtgcctgacggcgcatcaactttatgtctatgatgtgcttcaataatttcgatatcggtgtagtcccccatcactttggctgctttctccagcagtttaagcatgacgttaacgccaacgctaaaattggctgcaaagacaatcgcaatatcggcggctgcgtcacgaatcgcctgtttaccggcttcgtcaaaccccgtagtgccgatcaccatccctttgccatgctggcgacaaaaagcgagatgattcagcgtaccttccggacgggtaaaatcgataaacacatcaaaatcatcttttaccgcatcgaggctgctttgcacggtaacgcctgttttccctgctccagccagctcaccggcgtcgctgcccagtaaagaagatccttcgcgctccagcgccgcgccaagctgcacgccctctaatgccagcgccgcctgaatcaactggcggcccatacggcccccggctcccgcgatggcaacgcggatgtttgcatcatgcatagctattctcttttgttaatttgcatagaccgttttcagagtaaccagcgcatcgctacgccgccagccaaaaacgctgataattagaaattaatgataaacagggagggatatcagtgaaaggcatgagtcgatgaatgactgcatgccgataacatgtgacaggttacggcaccagagccagcacctcagctacccactgctggaagccttttacattcagatccaatgccacctgtacattggctggtttgcccaggcaaccgtcgatatcaaccaccgtcgtgcctgaggtaaattcgccttgagtttctaccgcgacaaaacacggcttgagggtgaataagtccgggcgcaccagccaggcgatggcgcagagatcgtgcattcgcagaccgctttgcatactgccgctacggtagtggctaaacagggcgtggagcatttttccggtgcgattcaactccggcaaagtagcgagatagtcaggggttaatattgcctgattggtgacatccagaccgcacatgacgatttcgatgccgctacggaagacacaggcagccgcttctggatcggcggcgatattaaactcggcatttggtgtacagttgccgcgaccagcagaaccgcccatgatcaccagacgacgaatatacggtttacattccgggcattgtgaaagtaacagcgcaatattggttaacgggccaatggccaccagggtaacaggctctggtgcacgcatcagggcatcacgaatcgccagaaacgctggtatcccgagtggctttcggttgtgctcaacaaagtcgtagccagccattcccgattcgccgtgcacagatgctgcatcacgcggtgcgcgtaccagcggcacagcggctccctgggcgagcggaatctccgcattccagaaatgcagcagttgcagggcgttgcgggtcgttttctcaaccgagacattacccgcgacggtggtcatcagttgcaggtcgagttcgggggcaaaaatcgcggcagcaatggcgacggcatcgtcaatgccggggtcagtatcgaggaagataggtaaacgcatgttttctccataaaaaatgccggtaacaagaccggcattttcgcataacttaggctgctaatgacttaatcgacttcacgaatatcgacacgcagctctttcggcacttcgaaaacaatgttttcttcacggccttccagcggaatggcttcaccaccacccagctgctgcaaacgtgccaccacattctgcaccagaatatccggagccgatgcgcccgcagtcacgccgacgcatttaacctctttcacccactcttcctggatatctttcgcatcgtcaatcaaaaacgcgcgtttgcccatccgctgggccagctccgccagacggttggagttggaggagtttttcgaaccgaccaccagcacaacttccgcctgttctgccagggcgcgtaccgcttcctgacggttagtcgtggcgtagcagatgtcatctttgcgcggaccgacaattttcgggaagcgtttacgcagcgcgtcgatcacatcagacgtgtcatccaccgacagagtggtttgggtcataaaggagagcttctcttcgtttttgaccgtcagtttccacacatcgtctggcgattcgaccagatacattcccccttccgggttactgtactggcccatcgtaccttccacttccgggtgcccggcgtggccgatgagaatagattcttcgccacggcgactggcgcgggcgacttccatatgcactttggtcaccagcgggcaggtggcgtcgaataccgttaaatcacggcttttcgcttcgttacgtaccgcctgagaaacaccgtgtgcggagaaaatcaggatcgcgccgtccggcacttcgctaatctgctcaataaagatagccccacgctcgcgcaggctatcgaccacgtagcgattatgcaccacttcgtgacggacatatatcggtgcgccgtaaatggccagcgcgttttcaacaatgctgatagcgcggtctaccccggcacaaaaaccacgcgggttggccaacaggatctgcatgttacgcctccagtgccggatcgatttccagcacttcaatatcaaaatgaacggtctgcccggccagcggatggttgaaatcaacggtaatggagtcgccgttaatttcgcggatcacgccaggcatctcactgccatccattgcggtaaaaagcatgattgcgccaatttctggctcgcctgcatccataaactcacggcgggagaagtactgaatcagatccggtgacggcacgccaaacgccgcatctggctccagcgagaaagtggttttatcgcccactttcagccccagcaggtgttgctccagcccttcggaaagagaagcatcgcccaggcggaatagcgccggtttaccgttgttgcgggtagactcggcggtggtgccatcgtcgagttttagcgtgaagtgcaccaggacggcgctattgctctgtacagattcagacatgcaggtttgctcttatttttgaggatttttgccggatgcggcctacgatttcgtagcaatctgtaggccgcatccggcagggtttattattgttttttcgctttagaaggtaaaaacccttccagcacgatcagtgccgcaccgacacaaatggcagtatcggcaaggttgaaggtggcgaagtgccagtcgccgacgtagaagtcgatcatatcgacaacgaagccgtgccacaggcggtcgaacaggttgcccagcgcgccgccaataatcagcgcgtaagcgatattgtttagcttctgcgtggccttcgagcgatacatcatcactgccaggatcacgctaataccaatcgcaataccggcaaagaaccaacgctgccagccgccgctatcggcaaggaaactaaacgccgcgccatagttacgcgcataatgcagattaagcgacgggaacagcgggaccgtatcccccagagcaaagttctggaggatcaggtacttgctgcccagatcgataatcagcacgactaccaccagccacagccagcgtagccctgttgaacagatcgattgactcatcaggcaaacttacgtttttcaccgtcaccggcgacgttgctgacacagcggccgcagatttctgcgtgttccgctaccttgccgacatcctgggtgtagtgccagcagcgtgggcacttctcaccttcggctttactcaacgcgactttcagccctttgagtacttcgctctgctgggcatcagcaggtgcgtcgttatagtctgcaacggtagcgccggaggtcaacaggacaaatcgtaattcatcgcccagcgcggtcagtttcgccgccagttccggttctgcgaacaaggtcactgccgcttccagcgagccacccactttcttgtcggcacgcgcttgctcaatgactttgttcacttcgccacgcactttcaacagctcgtcccagaacgcatcgttcatcgcttcactgtctgccagaccaaacaggccttcgtaccactcgccggtgaagacgtatttttcacgttcacccggcaggtagccccacacttcatcagcggtgaaggagaggattggtgccatccagcgcaccagcgcttccgcgatgtgatacagcgctgtctggcagctacgacgcgccacactgtccgctttggcggtgtactgacggtctttgatgatgtcgaggtagaaggaacccatctcaacggagcagaagcgcatcagacgctgtaccacttcgtggaaatcgtatgcttcgtacgccttgaggatgtcttcctgtgccgctttcgcacaacctacggcccagcgatccagtaccaccatctcttccggtttcaccatatcttttgccggatcaaaaccgttcaggtttgccagcaggaagcgcgcggtgttacggatacgacgatagctgtcggcagcacgtttcaggatctcgtcagaaacggccatttcaccggtgtagtcagttgatgccacccacagacgcagaatatccgcgcccagtttgttcatcacatcctgcggcgaaacggtgttgccgatggatttagacatcttgcggccctgaccatccacggtaaagccgtgggtcagtacctgacgatacggtgctttgcccttcatcgcggtagagatcatcagagaggacatgaaccagccacggtgctggtctgaaccttccagatacatgtccgcagcgtgaccggcaaattccggacgcacgtcaacaacggaagagtgggtagatccggagtcaaaccatacatccagcgtatccggcactttcacgtactgatcagcttcgtcgccgaggagctctttcgcatcgagatcccaccacgcctggatgccgtcaacttcaacgcgtttagccacttcttccatcagttcgagggtacgcggatgcagctcttccgtgtctttatgcacgaacagtgacatcggtacgccccaggtgcgctgacgggagatacaccagtcaggacggttagcaaccatcgactcgatacgcgcctggccccagtccgggatccactgcacgcctttgatctctttcagtgactgcgcacgcagacctttctgatccatgctgacgaaccactgcggcgtcgcgcggaagatgatcggcgttttgtgacgccagcagcacggatagctgtgctgcattttctcaacgtgcaacagcgcgcctttttcctgcagcagcgcaacaacgatgtcgttcgctttgaaaacgttcacgccatccagcgtcgggtaagtacccggcagataagtgccgtccgggccaaccgggttagcggtttccaggccgtatttctgaccgatcacatagtcgtccgggccgtggccaggcgcggtgtgaacggcaccggtaccggcatccagggtaacgtgatcgccgaggattgccggaacgtcgaagcccataaacggatgggtaaagcgcagcagctcaagctccgcaccttttaccgtgccgagaatggtgtaatcggtcacgccgatacgctgcattacgctttcaaccagatctttcgccagaatcacggcctgaccgtcgatctgcaccagcgcatagtcgaaatcaggtgcaatagagattgcgcggttcgcaggcagagtccacggcgtggtggtccagatcaccagcgagattgggccgttaacgttgcttacggcaaattttgctttcagtgcatcctgatcgaccgcctggaaagcaacgtcgatggacggagaagttttgtcgtaatactcaacttccgcttccgccagcgcagaacggcagtcaacgcaccagtgtaccggcttcgcgcctttgtgcaggtgaccgttgccgatgattttgcccagcgcgcggatgatattggcttcagttttgaaatccatggtcaggtacgggtgggaccagtcacccagcacgcccagacggataaagtctttgcgctgaccgtcaacctgggtcgcagcgtattcgcggcacttggcgcggaactcagcggcggtgaatttctcacccggcttaccgtattcttgctctactttcagctcgatcggcagaccgtggcagtcccagccaggcacatacggcgagtcataaccggaaagccctttggacttcacgataatgtctttcagaatcttgttaaccgagtgaccaatatgaatgctgccattcgcataaggagggccatcatgcagaatgaaggtttttttgccttttttagccgcacggatgatgccgtacagatcatcatcagtccaacgcgccagcattcccggttcgcgcttggcgagatcgccacgcatcgggaaccctgtttccggcaaattcagggttgatttatagtcactcatcagattctcggttccgtgtttcggtttgattacataacaggcttaagccggttttgttagcccaaaaaattcgcgggcggttaattcatcacgcgcaatctgcgctttcagttcgtccagcgacgcaaatcgctgctcattgcgtatttttttacgcagcactacttgtatatggcgaccgtaaaggtccattgcaacatctaacaaatgcacttccagctgctggcgaataccggcaaccgttgggcgtgttccgatgtttgccacgccgggtaacggcttttcaccgaggcccagcacttctaccgcataaacccctttcaccggggaaacctgacggcgcagcggtacattcgccgtcgggaaacctatagtgcgccctaattcatcaccgtggactacacgcccggagatggcaaacgggtgccccagtaaactttctgccagagccagattgtcatccgcaagggcctgacgcacggcggtgctgctgatacgcacgccaccttcgcaaaaagtttgcgtactggtgatatcgaagccgtattccatgccagctttctgtaataacaagaaatcgccttcacgaccagcgccaaagcggaaatcatcccctacagcaagaaattttacgcgcaaatgcttcaccagaagatcgctgatgaaattttgcgcggttaacgccgcgaaacgcctgtcgaaacgtacgcacagcacgtaatcaacgccacactctgcaaggtaacgtagtttttcccgcagccgggtcagtcgtgccggggctttatcggttgcaaacagttccagtggttgaggttcaaaaagcatcaccatcaccggtaagttgcgcttgcgcccttcttcctgcaagccctgtaacagcgcgcgatgaccgcgatgcacgccgtcgaaattaccaatagtcagcacacacccttcttgcggggcctggctgagattatgtatgccgcgtatcagcttcatgtctggctcaaaacagtgaaaatcgtccgagtataccttgtacagcggtcaaggttaaccggcgattgagtaccgaaatcagaaagaagtggcttttcattgccatggcgcaaatcacgggaagaaactgaccacctgctgcaatttttatcgcggaaaagctgtattcacaccccgcaagctggtagaatcctgcgccatcactacgtaacgagtgccggcacattaacggcgcttatttgcacaaatccattgacaaaagaaggctaaaagggcatattcctcggcctttgaattgtccatatagaacacatttgggagttggaccttggctaatatcaaatcagctaagaagcgcgccattcagtctgaaaaggctcgtaagcacaacgcaagccgtcgctctatgatgcgtactttcatcaagaaagtatacgcagctatcgaagctggcgacaaagctgctgcacagaaagcatttaacgaaatgcaaccgatcgtggaccgtcaggctgctaaaggtctgatccacaaaaacaaagctgcacgtcataaggctaacctgactgcacagatcaacaagctggcttaatcgccaatttgctgaagctttgtgaaaaagcccgcgcaagcgggtttttttatacctgctgctttgtgatgtgttagaaaacacactgccggttgccagatagtcaaaagatgctggttcttgcagacatgcagttacactctctgaactcttcgtgacttaaaaatcgtagaatcatcggttgatacattctgaataagaatatctactcaatcttcagactccccctacacagaatgtggagattgtgatacacattgaggtattaaacttaagaccactctatttttgaattaaattcctatacactttaaccattcataaatatctccttattagaccttgtaaattattaacagcaatcaacacaggttatctacctatttatattgtacttcttaaaattaatgagcgatttttgatagtcctcacattcactcataaattaaattaataaaaattcatcaacttcaaggactgataatgacagatggtatctcaacttcgccacattgtctttataaatcaaatatagcagatgatgtaataataaataaaacaagacaaaatgagttagtaaaagtgttttgcgagtataaaacagagttcttaattttgtttgatgacttttttagaagccaggatttgcctaaaccatctccagtccttcatcatttttttcaatacactcatctaagagatgcgcatttttatagatgtaaactcatagaacatacagttcaattttctttttttaaacacaaagaaatcacattacttagattggatgtttttgatgacagaacaagcgaatgtctttctgaagaaattaagatatatcaagaatgctatgaaaaattcgttaagtttttaaaggcaaacttcaaccaagaaatatacccacagctatatactcctgaaatattttatgaggcctgcagaaacctccagtcattttatgatcatcaggagacgtcacaaaacgctaattacagtgcaatagacaagaaaaaaagttattttaataaggaaatcaaaaatctaattaaaaagaatatttatcctgagctatacaatgaacaatgcttgaaaatccccgcctcatcgacagatgataaccaggaaataacatggcggaattttaaaactagcaatgcggcatattcacaactatgtgaaaaattatctttatttaaaagcgtgcccagtcggttaatagaaaaatcagcttactgctcaattgaaaacatgatcaccaataaatttgatgttgtcttttctttctgcggagatgatataaaggaatttatacttttattaccctataataaatcactggagatgtatgaacttaacgagcaaaagatccagtatttgactacccctaatattaatataaataaactattgctatcaaatataacaatagaaaagagcaacctttcatatgggtattattttggttgtgtattatccaatatatcatgttttgaaagcgacttatcaaacaccatcttttcaaatggagaaataaataatctcttcattaaaaaaagcaacatatttggaacatcgttcactaataccaggataaaaaatttgcgctgtgaagatattatgcctggtcgatggaacactcaacttgtcaataagcacttaggttacagatacacaggagtattcaaaaccctggcaagtattgatgacaaaccgtcccgtttcgaaattttgataccattgatacaaactttagttcgcgacaatgtaaagctaaataatgatgtgtataaagaacttaataattttatgctcgattacgacaaaacatcctcagaaatgagaaaataccttaaaagcatcaacgagtgtatgttccttatgaaaaacatagttcatcaagattaaaacactcccaaaagaagtaatttcagaatgaaattatctgtgatgattattaattcactgcagagaaacaaaaaataatctgaagcatgatcttaaacatcccactctgtcactctaatgatggcaccttgctcttcttataaagaagggaataattaagaatattaaattttcaaagtttcatcaacttcacatcaagaaattaaaaaatttaaacattaatctaaataataacaacctgatcacataatcgggtttgacaacgagtgaccttccataccagttaattaaggatgatttatgaaaaagtatattattcccttcgttgcgacaacgttgatgtttagcgcaacaaccttcgccaaggatgtcgatcaaggaacgctaaccattagaggagaagttgttgatacaacgtgttactttgttaatggtgattcgacaacagatatcgttgtcgaagatgttgtaaccagtgcaatgaatcaacttatcaataatgaaatctatactttaaaaaccggttcaacctctcatgacttagaaattcagtgtgacggcaatacagccccaagtatcgaagtgctagcatcagagtttgatgctaataactttacgctgaataaaggaactgctgagaacattggctttgccattttcctcgatgatggaactttgaccagaatgagaccggggttaaaaacaccgctgaaagataatggctctggtcaatattttcttaatttaagtgcacaatatgcccgcacaagtggcaatcctgttacaaaaggctccgtagagtcaaccgtaacgattaaaatcagtgcagattaacgttttttgccggtagctctgctaccggtattatttacggagtgattacgtgagaataataacagcattactgatgtcattttttattttacctgttcatgccggtgtggtcatctatggtacgcgcattatttatccggaaaaaaacagagaagttctcgtacagttaatgaatcaaagtaaaaatgcctctttgattcaggcatggatcgatgatgggaacaccactatcgcgccagaaaaaattcaggtcccatttattctcacaccgccagtaagtcgtgtagcaggtggttctggccaacaacttaaaataagaaaaatgccaaacaatttgcctcacaataaagaaagtttattttatctaaatgttctggatatccctccaaacaacccacaaaatgcaggaaaaaacaaaattaaacttgcattgcaaaaccgtataaagttactttggcgtccaagcggaatagctccggtagataaaaaaagcctttctcaattaaatatcaaaaagaaaaataacgccatctcaataaacaacgaaacagccaactggataacggttacaactatcaaagcacaaaacgtgaaagttaataatgaaagtatcttactgcctccattttcgaataacgacattacattaaaaaataaccacgcatcagaatatgaactaacggtagttgatgattacgggaataacatccatagtaaaatcgccgcacgataacaggaaaaagtcatgttaaggacgacacgatgggtcgctgctattatttttttgtattcttttccgggttatgctgaagaaacttttgatacacactttatgatcggcggcatgagaggagaaaaagtttccgaatatcgtttcgataataaacaacctcttccgggaaactacgaacttgatgtttatgtaaaccaccagtggcgtgggaaacaagatatcacgatcccagagtcaccagccaaaccatgtctgcctaaggtgctactaaccacactgggggtaaagaccgataatctcaatacagaagataattgtattttactggatgaagcggttcatggtggacaatatcagtgggatatcagtgaacaccgactaaatttaacgatcccacaggcgtatatcaatgaacttgaaagaggttacgttcccccggaaagttgggatcgcggcattgatgctttttatacctcctataatttaagtcagtatcgctcttatgacagcaataataacagtaatacagccagttatggccggttcaacagcggattaaatttatttagttggcagttacactctgatgccagttatagcaaacctgatgatatgaaaggcaaatggcaaagtaatactctttacctggaacgtggctggtcgcaaatattaagcacagttcagataggagaaaattacacatcctcactcatattcgactctctgcgatttagcggaatacgcttatttcgcgatatgcaaatgctacctgattctatgcaaagctttacacctttagtacaaggtgttgcgcaaagtaacgccttgataacggtttcgcaaaatggctataccatttaccaaaaagaggttcccccaggaccatttactatcgcagatttgcaactttcgggcagcggctctgatctcgatgtcagcattaaggaagcagatggtagtgttcgttcctttttggtgccctactcttccgtgcccaatatgctgcaacctggtgtttcaaatttcgattttatcgccggacgcagtcagatatatggtgtcaagaatcaggaggactttctcgaggcaaattatatatatggcctcaacaatcttttgacactttatggcggtacgattttatccgataactataatgctataactctgggaaatggttggaatacaccgctgggagcaatctcttttgatgctacccgatcgagtagtaagttaaataatgataccagacacgaaggtacgagctatcaggtcgcctataataaatatctattgcaaacggctactcactttagcgtggccgcctggcgttatgcttcgcaggattacaggacattcagcgaccatctttacgaaaatgataaaataaatcatcagagtgatgatgacgatttttatgatattggcagaaaaaatagcctttctgccaatatcatgcaacctttatccaataatctgggaaatgtatcattaagtgcactttggcggaattactgggggcgaagtggaaatgctaaagattaccaattcagttattccaatagctggcaacgcatcagttatactttctctgccagccaatcctatgatgaaaacgacaaagaagaggagcgttttaatctgtttatctccattcctttctactggggggatgatattgccaaaacacgtcaccaaattaacttatcgaattcgacctcattttccaaagatggctattcctccaacaatactggaattactggcatagccggtgaacatgatcagttaaattatggtatatatgttaatcagcaacaacaaaataatgatacctcgcttggtacgaatttaagctggagaactcccatcgccacaatagatggcagctatagccattctaaaaacgcctggcaaagtggtggaagtattagtagtggattagttgtctggcccggtggtattaatataactaaccagttatccgatacatttgcaattctggatgcgcctgggttagaaggcgcgcatattaatggacaaaaatacaaccgaacaaacagcaaaggccaggttgtttacgacctgatgatacctcatcgtgaaaaccatctggtacttgatatagcaaacagtgaaagtgaaacagaattgcagggcaatcgtcaaattattgcgccttaccgtggagcagtttcttatgtgcagtttacaactgaccaacgtaagccctggtatatacaggcactgcgtcccgatggttcgccattaacctttggctatgacgtactggatctccaggaaaacaatattggagtcgttggccagggtagtcgcctttttattcgcgtagatgaaattcccactggcatcaaagttgctctcaatgatgaacagaacttattctgtactattacttttcaacacgttatcgatgaaaacaaaacatatatatgccagtaaaaggagtttactatgaagtggcttttattaatcaccttgagtctatattcttttattgtgcaaagtgctccctgtgcagtgaccaatgtcggtgaacaacgtggaacatatatactcaagccactgagtatgaaaggtaatctaactgccgagaaaattgaaaaccccgggaatatcattgagtgtgcagacttgcaagagacgaccaacgccattaaagttcattttttaacacagaacgctttaaggtttaaagtcggaagtcgtcattacattattaatttcccctttgaatctgacggtaaaaaaatagagcttccagggaagttatcttataatttagaagaaatgctatctgcgataaatttcaccattccatattctatcgcatctgtatcagatagttctgacaccgcagatatttttccaggaactccttttcctttgctgttcgaaattgaagtgagttcatgcacagggaataatactaattgtaatagcgtccgctttaattttaatttaaatactattttacaggtaaatttaatgacctgtggttttgaagatcaatccatcgacactggacgatttgtactgtctcgtatcaataatgaaaattatcagtttcatcatataagatttgactgtatccagggtgagcaaggtgaattagtttttgaacccagtgatgttgaatattactttgagccagtgacgatacaggagtcaggaaccagcatattaaaaaatgatttagaaaacagtgaggacggtgcgggtcaaataggctttcaactctccaatgatggtacgaatgaaatccagtatggtaaaagcaattactactcttttcagcatccccatgaaggaagtaatcagattcctctatttattcgcccgcgtacatatggaaacaatgtctcaagcgggcaaataatgagccgagtcaaaatcgtggtaatgtacaactaatctatctcccccaccttaactttgggggagctgccgattaacgtgccgctgggctaaaaagcgcagaataatccgtattgcagattcgctgtaccgccgggtgctgaatcatccgctcagcaaaaatagcatggtactcttccatcacattttcgacgcgaccaatttctacgacagttttatcggcataaaagtcatatgcataaagcgttggggcaacgaagattgcattgtgcatcgcaccaaaagctttcatcaacgcggcatcatcaaactcgccgaggatttctacgtttaatccctgggagttaaaccagttaagcaatttgcgccctaacattgaacgtcgcccaggaatcaaaagccgccgttcttccagacaagccgggaacggtttttccggtggtggatttgtacaccagaaactcacgccacattcgccaattctcacggagaacagaccttcctgctgcgtagaatctatcggacagtcggaaatgatcatatccagtttatgctgacttaattgctccagcagcatttcgtgggtggattcgaagcagcgaagatgaatcggctcgccttctaccactgcggcgttaagtacgctactgaccaggcgtttagaaagtgcatcagccacgccaacgtcaaacaataaattggattctttgcgatagttcacgatatccagcatttcctggcttaaggtgaacattttatcggcatagcgatagaccagctctcccagctcgctgggctcgaggccacgtcccttgcgcttaaataatttgccttgcaggcgctcttccagcgcccgaatctgtccggtaatggtttgtggtgttaaataaagcgcctccgctgcgccaaccacggaaccttctttatagacatgccagaagtaatacaagtggttgtaattgatatgagacatgctcatttctctccctgataacaatgaaaagggagccgtttatggctccccggtaaaccgtcctgtcaaactgatggacgcaaacgaacgcgtaaccagctgtatccaattaccgccgaagagatagaaccgaccaggataccgagtttcgcccagttaatcagttctggatctacgctaccaaaggccaggctggcaataaagatagacatagtaaaaccgataccgcacaggatccccaccgccataatttgctgataagtcgttccctcaggcagatgcgccaatttcaaacgcagcgccaaccagcagaacagactaatccccagcggtttgccaatcagcaagccagcgatgatccccaatggcagaatggaggtcaagccatccagcgtgacgccttgcagtgaaacgccagcattagcaaatgcaaacagcggtaaaatcagatacgccacccacgggtgcaacacatgctccagtcgcttcgctggagaacgcccatgcttctctttcaaaggaataaagaagccgacaattacccccgccagggttgcgtgaacccccgatttcaacaccgcagtccacaacaccacgccaaccagaatatagacgcccgtgcggcgtacaccacacagattcaataccgcgagtaccgcaattgctacagccgcgacaccaagagaggccatcgataagtcattagtgtagaacaatgcgatgataatgatggccccaagatcgtcgataatagccagagccatcaaaaagatcttcagcgctaacggaacacgacttcccaacagcgccagcacaccaagtgcaaaggcaatgtcagtagccgccgggatcgcccacccttcgcgggtaatcggatcggcatagttaaaggccagatagagcaatgccggcacaatcatcccaccaatagcggcgataactggaaatgcggcctggcgtaagctggctagcgatccttgcatcagttcacgtttaacttccaaaccgactaacaggaaaaataccgccatcagcgcgtcatttatccataacagcatgtttttgttgatttcgagtgaaccaacccggagctgaaccggcgtctccagaaagtcgtgataccatccactggttgcgccgctattggccataatcatcgccaggatagcggcaatgataagaataatgcctcccgaggcatcactgctaaagaatcgatgcagatgtttcactttttatttctctttcaggtgaatagatcgtttttactattttaccccgcacgaatcatcgttaaaatcagattatagtgtaggaataattcgttttttacgaaccattgaaggatttgcgtcatcagtgatgagatgagtttttgacggctgtaagcgctgacgtgtgaccctaagccctgataatcatagcttaaggtcaggatttctgagggattaattaggaaaagtaataattaatttgttgtcagtctgcgatgtttgttaggccaatatttcaaaaataatccagtttgtcgacaataattgcgatgaagagataaattaaagttaaataattaaatcattaaaaaattacgccataaaaatgcgaggcgtcttcaggattagaatcgataaaacagaatgggttaaagagagcgatataatagcggcgggtgcttgaggctgtctgtctcaggcattagctgaacggcagatagagaaaagccccgagtgatattttaccatcaacccgaggccccctatatgctgaacacatgtagagtgcctcttactgaccgtaaggtcaaggagaagagagcaatgaagcagcataaggcgatgattgtcgccctgatcgtcatctgtatcaccgccgtagtggcggcgctggtaacgagaaaagacctctgtgaggttcacatccgaactggccagacggaggttgctgttttcacggcttacgaatccgagtaagagcaacggcggggagtgatccccgccactttacaggtgctcgcatatcttcaacgcaccctatttttacccaagcctgcccacgggcaggcttttggggaggttagcgagtcaggtcgtcgaaaaacttcttcacaccatcaaagaagctctttgaacgcgggctgttgtgctcgccggttgggccaccgaagctttcctgcagctcttgcagcagctgtttctgcttctcgttcagacctaccggtgtttcgacgacaacgcggcacagcaaatcaccctgtgcgccaccgcggacagacttgacgcctttaccgcgcatacggaacagcttaccggtctgggtttcgccaggcactttcagtttgacgcgaccatcaagggtcggtacttcgatttcgccacccagcgccgccatagcgaagttgatcgggacttcgcaatagaggttgttgccttcacgctcgaaaatcgggtgctgtttaacctgaacctgaacgtacagatcgcctgccggtgcgccatgctcgcccgcttcaccttcgcccgcaagacggatgcggtctccagtgtccacccctgccgggattttaacggacagcgttttgctgcgctcaacacgaccatgaccatgacatttgttgcacggatctttgatcagcgtaccccggccctgacagtgtggacaggtctgctgcacggcaaagaaaccctggcgcatctgcacctgaccagaaccatgacaggtcggacaggtctgcggctgtgtacctggttttgcaccgctaccgtggcaaacgtcacactcttccagagtcggaatgcggatctctttggtcacgccacgtacagcttcttctagggtgagctccatgttatagcgtaaatcagcaccgcgcgccgcacgttgacgaccacgtccgccgccaaaaatatcgccgaaaacgtcaccaaaaatatcgctgaagtctgcgccgccgccaaaaccgccgccgcccatgccgccttgctcaaacgcagcatgaccatactgatcgtatgccgcacgtttttgcgagtcggtcagaacttcataagcttccttgatctctttaaatttcgcctcggcctctttgtcaccctggttacggtccgggtggtatttcatggccaggcgtttgtaggcctttttgatttcacgctcttccgctgttttggaaacgcctaaaatctcgtaataatcttgcttagccatcttttttaaattgcccctagatgaatgcacgggcggagaggaaataccccttcgcccgtgtcagtataattacccgtttatagggcgattattttttgtctttgacttcttcaaattcagcgtcgacaacatcgtcatctttcgcgttgtttgcagaagcatcagcaccggcagtctgctgctgggcatgttgctgctgggcgatttccatcagtttctgggaaacctgtgccagttcctgcattttcgcttcgatagcggctttgtcttcacctttcagagcagtttccagtgcagtcagtgcagactcgatagcagttttgtcgtcagccggcagtttgtcgcctgcttcttcaacctgcttacgggtgctgtgcagcagatggtcgccctggttgcgagtctgtaccagctcttcaaacttacggtcagcttcggcgttagcttctgcgtcgcgtaccattttctggatttcatcttcgttcagaccagaagaagccttgatggtgatcttctgctctttaccgctgtttttatctttcgcggaaacgtgcaggataccgtcagcatcgatatcgaaggtaacttcgatctgcggcatgccgcgcggtgccgggttgataccatccaggttgaactgacccagagatttgttatcagctgcacgtttacgttcaccctgcagcacatggatggttaccgcagactggttgtcttcagcggtagagaacacctggctgtgcttggtcgggatagtggtgtttttcgcgatcagcgtcgtcatcacaccgcccatggtttcgatacccagagacagcggggtaacgtccagcagcagtacgtcttttacgtcaccagtcagaacaccaccctgaacagcagcaccgattgctacagcttcgtccgggttaacgtctttacgcggctctttaccaaagaactcagcaactttcttctgaaccattggcatacgagtctgaccaccaacgaggataacgtcgtcgatatcagatacggacaggccagcgtcctgcagtgcaactttcagcggctcaatggaacggtttaccagatcttcaaccaggctttccagtttcgcacgagtcactttgatgttcatgtgtttcggaccggtcgcgtctgcagtgatgtacggcaggttaacgtcggtctgctgagcggaagacagctcaattttcgctttttctgccgcttctttcaggcgctgcattgccagcggatcgttgcgcaggtcaatgccctgatctttcttgaattcttcaaccaggtagttgatcagacggctgtcgaagtcttcaccacccagatgggtatcaccgttggttgccagaacttcgaaggttttttcgccgtcaacttcgtcgatttcgataatagaaatatcgaaagtaccaccacccaggtcataaaccgcgatagtacggttgccagtacctttgtccagaccgtaagccagcgcagctgcggtcggttcgttgatgatacgttttacttccagaccagcgatacggcctgcgtctttggttgcctgacgctgagcatcgttaaagtatgccggtacggtgataacagcttcagttaccggttcacccaggtaatcttcagcggttttcttcatttttttcagcacttcagcagagatctgcggcggtgccattttctggcctttaacttcgacccatgcgtcgccgttatcagcagcaataattttgaacggcatgatggaaacatcacgctgtacttcttcgtcctggaagcggcggccaatcaggcgtttaatcgcaaacagggtattttgcgggttcgtcactgcctgacgtttagccggctgaccaaccagagtttcaccatcctgggtataggcaatgatagaaggcgtggtgcgatcgccttcggcgttctccagtacacgaggagtggtgccatccataatcgctacacaagagttggtagtacccaggtcgataccaattattttacccatctaaacgtctccactatatattcggtcatcatgtggttgtgagtctgtaataggggcgaaacgtctggtttcaactgcccaatttcatttttttgcagactcactcactgcggttgactactaaatggggtcgtaacccacgtcatcaagggggagatgcaaaaattttttgtgcttttgcgcagaaatttcgcgatatgccagaacaagacatgaaactgacagcaattttattcatatagagaatgaatagcagccaagacattcatagaaaaattgtaataaaaagaaaatattacgtacctgaatcttctctttatcagcagtaaactagtgggtattcatcccctacctctccccactaagagaatccttatgaaatccgtttttacgctttccgccagcctggcgattagcctgatgctgtgctgcacggcgcaggcaaacgaccataaaatcctcggcgtcattgcaatgccacgtaacgaaaccaacgatctggcgctgaaacttcctgtttgccgaattgttaaacgcatacaactctcagccgaccatggcgatttgcagttaagcggtgcatcggtttatttcaaagccgcccgtagcgccagtcagagcctgaatattccttcagaaataaaagaagggcaaaccactgactggatcaacattaacagcgataacgacaataaacgctgcgtctcaaaaatcaccttttccggccatacggtgaactcatcggatatggccacgctgaaaattatcggcgacgactaacgccagaatatagaagccacaaaaaatgaatgttaattacctgaatgattcagatctggattttctccagcattgtagtgaggaacaattggcaaatttcgcccggctgctcacccataatgaaaaaggcaaaactcgcctctccagcgtactgatgcgcaacgaactgtttaaatcgatggaaggacatcccgagcaacaccgccgcaactggcagctgattgccggagaattacaacattttggtggcgatagtatcgccaacaaactgcgcggacacggtaaattgtatcgggccattttgctcgatgtttcaaaacgattgaagctgaaagccgacaaagagatgtctacgtttgaaattgagcaacagttactggaacaatttctgcgtaatacctggaagaaaatggacgaggaacataagcaggagtttctgcacgcggtcgatgccagggtgaatgagctggaagagctgctgccgctgctgatgaaagacaaattattggcaaaaggcgtgtcgcatttgctttccagccaattgacccgcattttacgcacccacgcagcaatgagcgtacttgggcatggtttgcttcgcggcgcggggctgggaggccctgtaggcgcggcactaaatggggttaaagcggtcagcggcagcgcctatcgcgtgacgattccagccgtactgcaaatcgcctgcctgcgccggatggttagtgccactcaggtctgataccagaaaccggggaaaattttcattttcccctcaaaagatcgtagacactgccccactggctgattattatgccgcgccctgaaaacactacagttattcagggaaattatttcaccattcattcgatgatgatttttgaggaattatgggcaacactaagttggctaatccggcaccgctgggcctgatgggcttcggcatgaccaccattctgcttaacctgcacaacgtgggttatttcgctcttgacggtattattcttgccatgggcattttctacggcggcatcgcgcaaatttttgctggtctgctggagtacaaaaaaggcaacactttcggtttaaccgcattcacctcttacggttctttctggctgacgctggttgcgattctgctgatgccgaaactgggtctgaccgatgcgccaaatgcacagttccttggtgtctacctgggtctgtggggcgtatttacgctgtttatgttcttcggcacgctgaaaggcgcacgcgttctgcaattcgttttctttagcctgaccgtgctgtttgccctgctggcgatcggtaacattgccggtaacgccgcaatcatccactttgccggctggattggtctgatctgcggtgccagcgcaatctatctggcgatgggtgaagtgctgaacgagcagtttggtcgcaccgttctgccgattggtgaatcgcactaattgttttgagatccccccgctcggggggatttttttattcgctaacttcgcgtcttgcactcttcggtctgaatgcagcaaccacttccggtgccgtttcaacgtatggcccttccagcaactgaatgcagtacggtacgctggcaaaaataccgtgcaccacaacgttaccctcagcgtcctttacaccttccagcgtctctttaatcgacttcggctgaccgggtaagttaaggatcagcgcctgtttgcgaatcacacccacctgacgcgaaaggatcgcagttggtacaaaatgcaggctgatctggcgcatctgttcaccaaagcctggcatctcgcggtccgctactgccagcgtcgcatcgggcgttacgtcacgacgcgccgggccagttccgcccgtggtgagcaccagatggcaactcatttcatccaccagctcacacaacgtttgctcgatgatcgcctgctcgtcggggattaagcgggtttccagttcaaacggcgtggttagcgccgatgtcagccattcttccaacgcagggatgcctttatcctgataaacgccgctggatgcgcgatcagagatggaaactaagccaatacgtaaagtattcatcaagatttttccgtttaaacagtctcgttaaacagaatgatacactgcgaagggagtgacagacaggcttcagaagaggtagcgtgaccgacttcccggtcacgctaagaatgattacagcagatcgccgatcattttttccagtttttcttggtcaacagcaaacttacggataccttccgccagtttatctactgccattggatcctggttgtgctgccacaggaactcggactcagtgatacgcgccggacgcgctttcacttcgccggtgtaagacagtttacgttcgatagccccttcgctctcagccagctctttcagcagtgccggagcgatggtcagacggtcgcaacctgccagttccagaatttcgccgatgttacggaagcttgcgcccataaccacggtttcataaccgtgctctttgtagtactggtagatttcagatacagaaaccacgcccggatcttctgccggagcgtactctttcttgtcggtattcgctttgtaccagtcaagaatacggccaacaaatggcgagatcaggaacacgcccgcttccgcacaagcacgagcctgagcgaaggagaacagcagtgtcaggttacagttaataccttctttttccagctgttctgcagcacggataccctgccaggtagaagccagtttgatcagaatacgatcgttgctaatccctgcatcgttgtagagtttgatcaggcgttttgctttcgcaattgacgcttcggtgtcataggaaagacgcgcatcaacttcagttgagatacggcccggaaccagtttcaggatttccagaccaatatttactgccagtttgtcggtcgcgtccacgatctgctgcgcgcgatcgttgctctgctgtttcgcccaggcgacagcatcatcaatcaacttacggtattccggaatctgcgctgcgttaagaatgagagaagggttggttgtggcatcctgcggttgatacagcttcattgccgcgatgtccccagtgtcggccactacggtggtgtactgacgaagggaggtcaatttgtccgtcatgatagtatttctctttaaacagcttgttagggggatgtaaccggtctgccctgatgatatcacgacgcaacgtcagcgcaaccgccgacaagacggttatcgccaggcgagactgtttcggatttctgacactgcgttgatatcgcccgccatttttatacaaaacctcatgtatgctacgcagaagttatcaagtacctcgtagcgtatatacttcttaaacaattggtaacgtttacacaggaaagtcatcgcgaccggcaataagagggatatgcatgccagattttttctcctttattaacagcgtcctttggggatcggtaatgatttacctgctcttcggcgcaggttgttggttcacttttcgcaccggatttgtgcagtttcgctacatccgccagtttggcaaaagtcttaaaaatagcattcatccacagccaggcggtttaacctcatttcaatcattgtgtaccagtcttgcggcgcgcgtgggtagcggcaacctggctggcgttgcgctggctattaccgccggtggaccaggtgccgtcttctggatgtgggttgccgcgtttatcggcatggcgacctcgtttgccgaatgttcccttgcacaactttataaagaacgtgacgttaatgggcagtttcgtggcggaccggcatggtatatggcgcgcgggctggggatgcgctggatgggcgttctgttcgccctctttttgctcatcgcctacggcataattttcagcggagttcaggcgaacgccgttgcccgagccctgagtttttcttttgattttcccccgctggtgacaggcattattcttgctgtctttgctctgctggcaatcactcgcggtcttcatggcgtcgcccggctcatgcaggggtttgtcccgttgatggcgttaatctgggtactgaccagcctggtaatttgcgtaatgaatatcgggcaacttccccacgtcatttggtctatttttgagagtgcttttggctggcaggaagcggcaggcggcgcggcgggatataccttaagccaggcgattactaacggttttcagcgcagtatgttttccaatgaggcaggaatggggtcgacgccaaacgcggcagcggcggctgcgtcctggcctccgcatcccgcagcgcaaggaattgtccagatgattggcatttttatcgacaccctggtcatctgtacggcaagcgccatgctgatattactggcgggtaacggcacaacctacatgccgctggaaggtattcagcttatccagaaggcgatgcgggtgttaatgggttcctggggtgcggagtttgttaccctcgtggttattctgtttgccttcagctccatcgttgccaactacatttatgccgaaaacaatctcttcttcttacgcctgaacaaccctaaagcgatctggtgtctgcgaatctgcaccttcgcaacggtcatcggcggcaccttgctaagtcttccgctgatgtggcaactggcagatatcattatggcctgcatggctattaccaatttgaccgccatattactgctctcgcctgtggttcataccattgccagtgattatctacgccagcgtaaactcggcgtgcgcccggtgtttgatccgttgcgttatccggatatcggtcgccagctttctccggacgcgtgggatgatgtttcgcaggagtaatcacaactatcgatcaactcattctctttttttgctaaagtcggcataaatttcctgcaaggactggatatgctgattcttatttcacctgcaaaaacgctcgattaccaaagcccattgcccaccacgcgctatacgctgccggagctgttagacaattcccagcagttgatccatgaagcgcggaaactgacgcctccgcagattagcacgctgatgcgcatcagcgacaaactggcgggtatcaacgccgctcgctttaatgactggcagccagatttcacgccggagaatgcccgccaggcgattctggcgtttaaaggtgatgtctacaccggcttgcaggccgaaaccttcagcgaagacgatttcgattttgcccaacagcatttgcgaatgctttccggcttgtatggcgtactacgcccgctcgatttaatgcagccttatcgtctggaaatggggatccgtcttgagaatgcccgagggaaagatctgtatcaattctggggagatatcatcaccaacaagctgaacgaggcgctcgcagcacaaggcgataatgtggtgataaatctggcgtcagatgagtattttaaatcggtgaagccgaagaaattgaatgccgagattatcaagccagtgttcctcgatgagaagaacggcaaatttaagatcatcagcttctacgctaagaaagcacgcggtctgatgagtcgtttcattattgaaaatcggctgaccaaaccagagcaactgactggttttaatagcgaaggttacttctttgatgaagcttcctccagcaatggtgaactggtgtttaaacgctacgagcagcgttaagtttgcagtaaatgccggatgcggcgtgaacgccttatccggcctacaaaagcatgcagattcaatatattgcagaattaacgtaggcctgataagacgcgccagcgtcgcatcaggcgctgaatgccggattgttacccggcatttgtcatttagcggtgatgtttgcctggaccatgaccgccgtgatgatcatgaggagctttcttatggtggcgcggcggtggcggcggtccatatgggtgccagcgattgcctcgccattcataatgttgtttccaccagccgtggtcgcgccagtgaccgccatcccagtaatagccacgattatcacgatcgcctatctgtaattttactgacgggactagcgtaatttccgcagcctgcgctgccatgggagcgaccagaaccagggaaagtgcgagtacgatagattgcatctttttcacaggttactccttttatcattgcccgttatgggtcgatatccggagattacgcgatgagaacggcagttgttattctccgcaatcctaatctctaagttaccgcatttattgagaatttctcctttttccctgtcgtttttctccatattttcttcataaaaaagccgggctgcataaaagcaaacccggcctgattgagataatgaatagatgttactgatgattcatcatcaatttacgcaacgcagcaaaatcggcgggcaggttatgcgaaagcaagggtaaatcagcacgttctgccagctcttttggcagatccaacgtttcaccgagaatcgcttccacgctctctttaaatttcgccggatgcgcggtgccgaggaacaagccatattcgcctggatgcaactggtcacgcagcgcacgataagctacggcagcgtgcggctccgaggtgtagcccagttcttttaactcacgcattgtctgttgcgtggtttcatcatccacggctgcataacccagctctttcagttgccagattttgcggcggaacaactcttccacacgcggccagttgttcggctgactcacgtccatcgcgttggataacgtcgcctgagtcgctttgggtaaccactgaccgtcgtgcaggaaacgtggcacggtatcgttcacgttggtcgcagcaataaaacgtttcaccggcagaccgagtgacttcgccagcagacccgccgtcaaatcgccgaagtttccgcttggcaccgagacaaccagctggttgcgcgcttcctgcggcaactgcgccacggcttcaaagtagtagcaaatctgcgccagcaaacggctgatgttaatcgagttagctgagtttaaccccagcgccactttcagttcttcatcatcaaacgcctgcttcaccagcgcctgacaggcatcgaaatcgccgtcgatggcaacagtttcaatattgccgcccaatgtacagaacagtttttcttgcagtggactgattttgcctcgtggatagaggataaccactttcacattcggcaaaccgtagaaagcatgagccactgccgctccggtatcaccggaggtcgcggtcagaatggtcactggcttatcgcccgcaatatgggtcagcatttgtgccataaagcgaccgccgaaatctttaaatgcaagcgttggcccgtggaacaactccagacaaccgacatcgctttcaacattggcgaccggagccgggaaggcaaacgccgcgcgtacgcgctcttccaggatttcctgcgggatttcatcaccaataaacgccgagaggatcttcgcactgcgggtgacaaaatccagcttcagcatctcatcaatttcagtcaggctgaattccggcaggtcgtgcgggaaaaacagcccctgatttttgcccaacccctgggttacggcttgcgcaaagctgacctgctcattgtgatctttaagattgtagagtttcatttagttttccagtactcgtgcgcccgccgtatccagccggcaaatatgaacaaaaccttcctgattttgcaggtagttcttacccaaccagtcggcaacgcgctgggcggtatccggcttgtcacacagagcgaacaaagtcgggccggagccggagataccgctcgctaccgcgccgatttccgcgaccgcctgccgcgcctgccggaagcctggcagtaaccgttcacggtagggttcagcgataacatctttcatcagcttcgcggcaagctcaggctgacgggaatagcaggcgtgaataaagcctgccagatgtcgcccgtgcgcaatgcaatcctggcggcgatactgcgccggtaaaatagccctggcttctgccgtcgagactttaatccccggatacgccagcacccacagccactcatcaaaccctggcacttgctggctgatgatgtcgttttcttcgatcatcaactgcataccaccaagaaaacacggtgccacgttgtcgtaatgaatgctgccggagatacgcccttccagctcgcccatcaaagccagcaaacgggtgtcattaagcggcttgccgcagtgttcattcatcgccatcagcgccgcgaccactgagcaggcgctggagcctaagcccgagccgatcggcatattcttttccagggccatcgccactggaatttgcttacccagctcctggcaaaaacgctcccaacactgataaacgatattttcccgaggttctgacggcagcttatcggcaaagcgtccgaggttattgagactgaatgtctctgccgcctcaaccgtgactacatctccgagcaatgcaccatcaacgggtgtcaccgccgccccgagcacatcaaacccgacgctcatattggcactggaagccggggcataaactttaaccatgtcagactcctaacttccatgagagggtacgtagcagatcggcaaaaacaccggcagctgtaacgtcattgcccgcaccatatccgcgcagcaccaacggcagcggctgataatagtggctatagaaggccagggcgttttcgccgtttttcactttgaacagcggatcgttgccatccacttcagcaatcttcacgcggcagacgccatcttcatcaatattgccaacatagcgcaaaacttttccttcatcacgggccttcgccacgcgcgcggcaaagagatcgtcgagctgtgacagattcgccataaaagcggcaacatcaccctcggcgttaaactctgcgggcagcacaggttcaatttcaatatccgccagctccagttcacgtcccgtttcacgagcgagaatcaatagtttacgcgccacatccataccagaaagatcatctcgcgggtccggttcggtataacccatttcccgcgccagcgtggtcgcctcggagaaactcatgccttcgtctaacttgccgaagatataagaaagcgaaccagaaagaatgccggagaacttcatcaattcatcacctgcattgagtagattttgcaggttctcaataaccggtaatccagccccaacgttggtgtcatagaggaatttacgccgcgatttttccgccgcatgacgcaacagatggtagtaatccatcgacgaggtgttagcctttttgttcggcgtaacaacgtggaaaccttcgcgcaggaagtcggcatattgatccgccactgcctggctggaggtgcagtcaacaatgaccgggttcagcagatgatattctttcacgaggcgaattaagcgcccgagattaaacggctctttggcttgcgccagttcttcctgccagttttccagattaaggccatgtacattggtgagcagagccttcgagttggcaacaccacagacacgtaagtcgatatgtttattcttcagccagctttgctgacgcttcagttgctccagcagcgcaccgccaacgccaccgacgccaatcacaaacacttcgataacctgatcggtattgaacagcatctgatgagtaacgcgcacgccagtggtcgcatcatcgttatttaccacgacagagattgagcgttcagaagatccctgagcaatggcgacaatgttgatattggcgcgggccagcgcggcaaagaatttcgccgagatcccacgcaaggtgcgcataccatcacctaccaccgagataatggccagccgttccgtcactgccagcggctccagtaagccttctttcagttccaggtagaactcttcctgcattgcccgttcagctcgcacacagtcgctttgtggaacgcagaaactgatactgtattcggaagatgattgcgtaatcagcaccacggaaatacgggcgcgtgacatcgctgcaaagacgcgcgccgccatgccaaccattcctttcatccccgggccggaaacgctgaacattgccatgttattcagattggaaatgcccttgaccggtaattcgtcttcatcacggctggcaccaatgagcgtacctggtgcttgaggatttccggtatttttaatcaggcaagggatctggaactgggcgatgggggtaatggtgcgggggtgaagaactttagcgccgaagtaggaaagctccatcgcttcctggtaggacatcgacttcaacaacctcgcatcgggcacctgacgcgggtcgcaggtatagaccccgtcaacgtctgtccaaatctcgcaacaatcggcgcgtaaacaggcagccagcaccgcagcagagtagtcggaaccgttgcgtccaagcaccaccagttcgcctttttcattaccggcggtgaaacctgccatcagcaccatgtgatcagccggaatacgacttgccgcaatacggcgggtggactcagcaatatcgacggtagattcgaggtaatgccccactgccagcagtttttcgaccggatcgataacggtaacgttgtgaccgcgcgcttctaatacgccggccataatggcgatcgacattttctcgccacggcaaatcagcgcagcgttgatgctatccgggcactgccccaacaaactaatgccatgcaggacatgttttatttgggcaaattcctggtcgacgaaagttttcagttgcgccagcgggaatcccggctgggcggcggcgagtcccgtcagaagttcggcaaaaatacgttcggcatcgctgatattgggtaaagcatcctggccgctaatggttttttcaatcatcgccaccaggtggttggtgattttggcgggggcagagaggacggtggccacctgcccctgcctggcattgctttccagaatatcggcaacccgcagaaaacgttctgcatttgccactgatgtaccgccgaacttcaacactcgcatggttgttacctcgttacctttggtcgaaaaaaaagcccgcactgtcaggtgcgggcttttttctgtgtttcctgtacgcgtcagcccgcaccgttacctgtggtaatggtgatggtggtggtaatggtggtgctaatgcgtttcatggatgttgtgtactctgtaatttttatctgtctgtgcgctatgcctatattggttaaagtatttagtgacctaagtcaataaaattttaatttactcacggcaggtaaccagttcagaagctgctatcagacactctttttttaatccacacagagacatattgcccgttgcagtcagaatgaaaagctgaaaaatacttactaaggcgttttttatttggtgatatttttttcaatatcatgcagcaaacggtgcaacattgccgtgtctcgttgctctaaaagccccaggcgttgttgtaaccagtcgaccagttttatgtcatctgccactgccagagtcgtcagcagtgccatggctcgttcgcgtaaagcttgcagttgatgtttgtctgccgttgtgtcacttttcgccggttgttgtattaatgttgctaattgatagcaatagaccatcaccgcctgccccagattgagcgaaggataatccgccaccatcggcacaccagtaagaacgtcagccaacgctaactcttcgttagtcaacccggaatcttcgcgaccaaacaccagcgcggcatggctcatccatgaagatttttcctctaacagcggcaccagttctactggcgtagcgtagtaatgatatttcgcccgactgcgcgcagtggtggcaacagtgaaatcgacatcgtgtaacgattcagccagtgtcgggaaaactttaatattatcaataatatcaccagatccatgtgcgacccagcgagtagctggctccagatgtgcctgactatcgacaatccgcagttcgctaaaccccatcgttttcatagcccgcgccgctgccccaatattttctgctctggcgggtgcgaccagaataatcgttatacgcatattgccactcttcttgaccaaataaccgcgaacagggtgatcactgtcaacttattatgcggtgcgaatttacaaattcttaacgtaagtcgcagaaaaagccctttacttagcttaaaaaaggctaaactatttcctgactgtactaacggtttaattgttaaaaaatgctacatatccttctgtttacttaggataattttataaaaaataaatctcgacaattggattcaccacgtttattagttgtatgatgcaactagttggattattaaaataatgtgacgaaagctagcatttagatacgatgatttcatcaaactgttaacgtgctacaattgaacttgatatatgtcaacgaagcgtagttttattgggtgtccggcccctcttagcctgttatgttgctgttaaaatggttaggatgacagccgtttttgacactgtcgggtcctgagggaaagtacccacgaccaagctaatgatgttgttgacgttgatggaaagtgcatcaagaacgcaattacgtactttagtcatgttacgccgatcatgttaatttgcagcatgcatcaggcaggtcagggacttttgtacttcctgtttcgatttagttggcaatttaggtagcaaacatgcagaccccgcacattcttatcgttgaagacgagttggtaacacgcaacacgttgaaaagtattttcgaagcggaaggctatgatgttttcgaagcgacagatggcgcggaaatgcatcagatcctctctgaatatgacatcaacctggtgatcatggatatcaatctgccgggtaagaacggtcttctgttagcgcgtgaactgcgcgagcaggcgaatgttgcgttgatgttcctgactggccgtgacaacgaagtcgataaaattctcggcctcgaaatcggtgcagatgactacatcaccaaaccgttcaacccacgtgaactgactattcgtgcacgcaacctgctgtcccgtaccatgaatctgggtactgtcagcgaagaacgtcgtagcgttgaaagctacaagttcaatggttgggaactggacatcaacagccgttcgttgatcggccctgatggcgagcagtacaagctgccgcgcagcgagttccgcgccatgcttcacttctgtgaaaacccaggcaaaattcagtcccgtgctgaactgctgaagaaaatgaccggccgtgagctgaaaccgcacgaccgtactgtagacgtgacgatccgccgtattcgtaaacatttcgaatctacgccggatacgccggaaatcatcgccaccattcacggtgaaggttatcgcttctgtggtgatctggaagattaatcggctttaccaccgtcaaaaaaaacggcgctttttagcgccgtttttatttttcaaccttatttccagatacgtaattcatcgtccgttgtaacttctttactggctttcattttcggcagtgaaaacgcataccagtcgatattacgggtcacaaacatcatgccggccagcgccaccaccagcacactggttcccaacaacagcgcgctatcggcagagttgagcagtccccacatcacaccatccagcaacaacagcgcgagggtaaacaacatgctattgcgccagcctttcaataccgcctgcaaataaataccgttcattaacgccccaatcagactggcgattatccatgccacggtaaaaccgatatgttcagaaagcgccagcaagagcaaataaaacatcaccaatgaaagccccaccagcaaatattgcattgggtgtaaacgttgcgcggtgagcgtttcaaaaacaaagaacgccataaaagtcagtgcaatcagcagaatggcgtacttagtcgcccggtccgttaattggtattgatcggctggcgtcgtcactgcgacgctaaacgcggggaagttttcccagccggtatcattgcctgaagcaaaacgctcaccgagattattagcaaaccagctgctttgccattgcgcctgaaaacctgactcgctaacttcccgtttggctggtagaaaatcacctaaaaaactgggatgcggccagttgctggttaaggtcatttcgctattacgcccggcaggcaccacagaaagatcgccggtaccgcttaaattcagtgccatattcagcttcaggttctgcttccgccagtccccttcgggtaaagggatatgcacgccctgcccgccttgctctaagccggtgccaggttcaatggtcagcgccgttccgttaacttcaggcgctttcaccacaccaataccacgcgcatccccgacgctaatcacaataaagggcttgcctaaggtgatatttggcgcgttgagttcgctaagacgcgaaacatcgaaatcggcttttagcgttaaatcactgtgccagacctgaccggtataaatccctatcttgcgttcttccacgttctgattgccatcaaccatcaatgactcaggtaaccaaaaatggataaaacttcgtttccgctccacggttttatcctcttcctgcaccgtataaagctcggtcacaggaatagcgatgagcggcccaacgagtttttgcggcccgctggtactttggcgaatcgcatcttccacatcgctacggtaatcagcacgttcgacaatcacctgccgaatcagcattatcggaatcaacaacagcaatactgcaccaaacagggtggtcattttccagaacaggggggatttcaacatagtcttctcctttgcaatggcagcaggatacgaaggctatgtgggaagaatttgaagctatgtgaagtgacggtgaagtcgaagcgaagccagcacgccaccttcttgcacgttgcgcagcgtgacttcgccgttaaacaaacgggcgacctcactgacgaacgccaaccccagaccgctgcttttttgcccatttgcacgcggcaaagagtaaaagcgttcaaaaatacgtgaaagcgcgtagtcaggaataccactaccggtatccagcaccttaagcgtgacgtgttcctgctccacttcggcgcttagcatgatgcaaccgctctcgggggtaaaatcgatggcgttatccagtaaatttcccagcgcctgctccagtaacgccggttcagcagcaacgttaacctcggtgggcgtaacatgcagagtgatttttttttctgccaactgcacggtgcgcgcttcgctgacgcggcggaataatgccgccacatcaacagcagtcagaacgacttcctgacaattctccagtcttgcctggcgtagtaacgtttccaccagcgcctgcatacgcgcattttgcgtcagaatgttgtcagtaaaacgagccaccacttccggcggcggaccttcgcgtaaaatttccgccgctccacgaatcgccgccagtgggctttttagctcatgagttaacgcgtaaacatactgctcaatatagtttttcccttccagcttcacgcgcatactttccagcgcctgcgcgagtttacgcagctcgctactaccgagatcgggaagaggaacgggcttattgtcagtgacggaatcagcatagcgagtgagccgggcaatggagcggttgatccaccaaaccatgcatgcgccaatcaccagtgcaatccccaacaaaatggcgctggcccataaaattcgccgctcgctgcgcttaatgaccggagccatcgccgcgttcggtttgcctacgctcaaaacgccaataagccgcgagccgtccataatcggcgcggcaacatacatcacagaactttcgggatcggcaggattttgcaacgtgctgcgcgcaccatactgaccacgcaacgttagccagacgtcattccagcgcgaataatcctgtccaacggctttatttgccgaatcgaacaatactttgccctgcgcatcggtcatatagacatgatattcattgcgcactttgttaatgccaccgatattggcgcgaaacgggcgatgttgtagctgattaaacgcctgcgccagttgcccatgcgttgggtccccagagagcaaatcgggacgcgccagctccgccagcaacgttgcggtgtcgattaacgtcccctccgttgctcttcgcacgcccggtttaacttctttgacaaaaatagccagtacgaaccaggccgccaccgccaccagtaaaaaatagcccagcaacaaccgcatgccgatacgcattacaggcccctcaggctatatcccatgccgcgatgagtattaatcggtgaaagatcggggttgatggcgcgcagcttggcacgcagcgttttaatgtgggtatcgacggtgcgatcgtaggtgtcctgcgcatcttcccacacgctatccatcagttgctggcgggaccagacgcggcctggcgacttgagtaacgtcttcagcaataaaaactcataccgcgtcagcgttaatggcgtgtcaaaccagctgatctgcgccgcgggttcattcaattcaaaatgaccaatacggatgacgggagacggcgtcgagaacttcttcacccgacgcagtaaggtgcgcaccctggcgcacacttcgcggggtgaaaacggtttagccacgtagtcgtcagcgcctatttccagcccaagcaggcgatcgacctcttcacttcgggccgtcaggaacagtacaggtaacgccggatggagcgccagtaactggcggcacaattcaaagccgctaatatccggcagaccaacatcgagaatcatgacgtcgggtacctgctggcgagctttatccagcaccggcaagcctcgctcaaagacctcgacggcaaaaccttcctgctgcaacatgtagaccagcgtgtcggctatcccttgctcatcttccactaaccagaccgtttcccgttgcataaatcgcctctgttattgccgccacggcatgacaggaaccgcgctaatcgcgtttttcggcgaaccttctacaactttgtcggagtaagccagataagcgagcgcgtttcgtttggcgtcataaaagcgcacgacctgtaacgacttaaagaccagggacgtgcgttttttgaatactacctcgccctgagctttgccgtttttaatacgatccgacagttcaatcggcccgacttgctgacaagaaatggccgcatcggaggtatcttctgccaggcccaatccccctttaataccaccggttttcgcccggctcacataacaggtgacatttttcacatcgggatcgtcaaaggcttccacaacaattttgtgatccgggccgatcattttaaatacggtgtcgaccgaaccaatctcttctgcatgagccaatggccccagcattatcaggcttaaagacaggatcaaatgcttgtatttcatattgttaccatttttatctattacacgagcaattagttcgttacggtaaataacatattgattaagaacaaaatctcaatacttttatttccgtcaagccctaaaacatactctactaagaaaaaaacactgaatgctaaaacagcaaaaaatgctattatccaattacctgatgtcaggtgctcgttgttgaaaggatgaggatattttatggatcaggccggcattattcgcgaccttttaatctggctggaaggtcatctggatcagcccctgtcgctcgacaatgtagcggcgaaagcaggttattccaagtggcacttacagagaatgtttaaagatgtcactggccatgctattggcgcgtatattcgtgctcgtcgtttgtcgaaatcggcggtcgcactacgcctgactgcgcgtccgattctggacatcgcgctgcaataccgcttcgactctcaacagacatttacccgcgcattcaagaagcagtttgcccagactcctgcactttaccgccgttctcctgaatggagcgcctttggtattcgcccgccgctacgtctgggtgaattcactatgccagagcacaaatttgtcaccctggaagatacgccgctgattggtgttacccagagctactcctgttcgctggagcaaatctctgatttccgccatgaaatgcgttatcagttctggcacgattttctcggcaacgcgccgaccattccgccggtgctctacggcctgaatgaaacgcgtccgagtcaggataaagacgacgaacaagaagtattctataccaccgcgttagcccaggatcaggcagatggctatgtactgacggggcatccggtgatgctgcagggcggcgaatatgtgatgtttacctatgaaggtctgggaaccggcgtgcaggagtttatcctgacggtatacgggacgtgcatgccaatgctcaacctgacgcgccgtaaaggtcaggatattgagcgatactacccggcagaagatgccaaagcgggagatcgcccaattaatctgcgctgtgaactactgattccgatccgtcgttaacgctgcagctcatctaatgcaggggcgtccagatgcgagatgtcccctgcggtttcaacgacccagccagacgccagccacaggctttcctgataatccacgcgcgaaatagaacagttacgcagacgtaagcgacgctctgcccatgctggtaatccgagaatcgtactcaccaggcatcccagtgcaataccgtggctcaccagcagcggtcggcttccctgcggtaagtcccggcaagattccagtgccgcattgacgcgatcgctgagctcctgcattgactcgccttcaggaatacgcccgtcaacggtgccattgaccagctgccgacgccagttctcttcttcttcggtcagagaatcgatatgtcttttttccagcacacccatgtttaattcacgcaggcgagaatcaaagatgatgtcacagccgcaggcctgggcgatgatttccgccgtacgccgggtgcgccctaaatcgctactgatgatatgcgtaatgccaagctctttggcacgggttgccacctgcatcgcctgttgctcacctttggcggtcagcgggctgtcagactggccctgaatacgtcgctcggcgttccactgcgtttcaccgtggcggactaggtatacctgtaacatgctttttttccgtatactgctgtaacgttaattttctgagtaatgctgattatgcaccaagttgtctgtgcgaccaccaatcccgctaaaattcaggccattctgcaggcatttcacgagatcttcggcgaaggatcctgccatattgcatccgttgccgtcgagagcggtgtaccggaacagccctttggcagtgaggaaacgcgcgctggcgcacgaaatcgggtagcaaatgcccgccgtttacatccagaggctgatttttgggtggcgattgaagctggcattgatggcgacagcactttcagttgggtggtgattgaaaacaccagccagcgcggcgaggcgcgttcggctactttgccgttacctgcggtgattttgcagaaagtgcgtgaaggcgaggcgctcggtcccgtgatgtcgcgttataccggtattgatgagattggtcgtaaggaaggggcgatcggcgtgtttaccgccgggaaacttacccgcgccagcgtctatcaccaggcggtgatcctggcgctgagtccgtttcataatgcggtgtatcagtgatctttcagcaacacctcttccagccactggcgcagctcaacgggcgcggctttcaggctgttagatccacgcgtaatcgtcgcgatgcccgcgccgagttcattttttaactcacgctggctcatttcgccgcgcagcagctcttcgacaatacgcacgcgagtccccaacgcttcgcgctcatctggcgtcagcatcaggtttaacaacggtaaatggagatcgttttggtaggcattcttaagcaggtcgacaaaacgtaaccactcctggtgacgctgttctgccatcgctgctgaatagggtgattgttgggccataatatgtcgccattgttagcgggggaagcaaaatgcctcccccggttgtactcgctaaagagtacgatagcatatcataaacgtgcggatcagtaacgacgtccccattccgtggcgctcatcaatgtcggtttatcccccatgaaatagcggtagtaagcgtcataagccagcacgttcttcacataaccgcgcgtctcggagaacggaatactctcgacaaatgccactgcgtcgatacgcccggcgctgttgccaagccaggttcgcacccgtcctggtccggcgttataagctgctgaggagaaaatacggttattaccaaactgctgataaacatattgcaggtaactggtgccaatgttgatgtttgtttccggatccagcaattgcccagggctgctataaccgggaatagagaacatcttcaccgtatgggtcgctgtacccggcataatctgcatcaggccgctggcccctaccggtgatttcactttcggattccaggcgctctcctgacgggcaatcgccatcgcatagctttgcgggatctccttcccactggtgtaacgtttgaaaagatcgttgtaagccagcgggaatcgctcttccagatgatcccatagcttcccggcgatcgttgcctgaacgctaagatcccaccattggttattgaaagcataccgagccagttgagcctgctctgtttttgacttgctcttcaccagattggcccactcgctacgcgcggtattatcgagattccagtacatcaactcgcgcacgcgcgccatctccggcccctgagtcagggcgctgtcaacattctgcggcgctttatcaatcttcagctcatactcttcgccgatgcgttgtgctgcaaccatcgggtagaaaccacgctgttgcatgagttgatgcaaaatctcttttgcttcagcttcacgtccgcgttccagcagtaaatccgcctgccagtaacgccattcatctttctctttcgcctccatcggcaaacgcgccagccaggtattcaggccgcgacgatcgccggtgccaagcgccattcgcacacggcgttcaataagcgaagtagattgcgaacgcataatggcgtcatcacgccatttcgcctgttcgtcggtgacatcgttgcccatcaaacgccaggcgacgatatcgcgcagctcctgaatctgatcttcattaagctgctgcgcctgggcaagcgacgggatcatcagccgtgcattttcagcatcctgccgcgccacactggcaaacgccaccgccgccatttgacgggtaaaatcggtcgctccggttgtacgcgcgaaggtcagtaccgtattaggattgtttgccagtgaaatgattgccgaagcgatagtctggtaatcggcaggcatctgccctgccagcactgttaccaggccagtgttacccgctttcatcgccagacggatacgctctaaatacgccagcggatcttgtttacctgacgcacgccagacgctaaataacttgtcacaggcgttaggctggctcttgccggttagccacagctctttcgccccttgccaggcttcttcactctgcccggtgttccatttcgcatagtagtaattacattgcgcttcggtagttccgggcttttccggactaaaggctaacaagccacgccagtcttcacgccgcgccagttcattgacgaaacgagattgcagcgtgcgagcgggaggaagcgtggggttagcgcgaacaaagttagtgaccgtcaccgccggttgattcatcaggtcatcggtgatctggcggtattccaggtagggataaagcggataatccttcagtccaggcatcatttgttcgaccacgtccatttgtcgattatcccaggcctgcttgatttgcgcgtaacgactacgctgctcatccagtgagtcggctcgcgccacactgctgaccgtcagcagacagacaccggcagccaacagccgccaggtaacgtgtttggctttttccacaagcgcatcctctaagtgtaaatacatcaatgcagcgtcatgccacgtaatagatttatgctaaccagtcattgccgtttacgccacgttacggacacttttttacttttactgcgagggtgatcgaccggctgggattagataaggaaacaggctacacttcgcctttgaaaactcatcatcacgataaacatagaggcgaagtccaacgtggctcaattcgtttataccatgcatcgtgtcggcaaagttgttccgccgaaacgtcatattttgaaaaacatctctctgagtttcttccctggggcaaaaattggtgtcctgggtctgaacggcgcgggtaagtccaccctgctgcgcattatggcgggcattgataaagacatcgaaggcgaagcgcgtccgcaaccggatatcaagattggttatctgccgcaggaaccgcagctgaacccggaacacaccgtgcgtgagtccattgaagaagcggtttctgaagtggttaacgccctgaaacgcctggatgaagtgtatgcactgtacgccgatccggatgccgattttgacaagctggccgctgaacaaggccgtctggaagagatcattcaggctcacgacggtcacaacctgaacgttcagctggagcgtgcggcggatgcgctgcgtctgccggactgggacgcgaaaatcgctaacctctccggtggtgagcgtcgtcgcgtagcgttgtgccgcctgctgctggaaaaaccagacatgctgctgctcgacgaaccgaccaaccacctggatgccgaatccgtggcctggctggaacgcttcctgcacgacttcgagggcaccgtggtggcgattacccacgaccgttacttcctcgataacgttgcaggctggatcctcgaactggaccgcggtgaaggtattccgtgggaaggcaactactcctcctggctggagcagaaagatcagcgcctggcgcaggaagcttcacaagaagctgcgcgtcgtaagtcgattgagaaagagctggagtgggtacgtcaaggtactaaaggccgtcagtcgaaaggtaaagcacgtctggcgcgttttgaagagctgaacagcaccgaatatcagaaacgtaacgaaaccaacgaactgtttattccaccgggaccgcgtcttggcgacaaagtgctggaagtcagcaatctgcgtaaatcctatggcgatcgtctgctgattgatgacctgagcttctcgatcccgaaaggagcgatcgtcgggatcatcggtccgaacggtgcgggtaaatcgacgctgttccgtatgatctctggtcaggaacagccggacagcggcaccatcactttgggtgaaacggtgaaactggcatcggttgatcagttccgtgactcaatggataacagcaaaaccgtttgggaagaagtttccggcgggctggatatcatgaagatcggcaacaccgagatgccaagccgtgcctacgttggccgctttaactttaaaggggttgatcagggtaaacgcgttggcgaactctccggcggtgagcgcggtcgtctgcatctggcgaagctgctgcaggttggcggcaacatgctgctgctcgacgaaccaaccaacgacctggatatcgaaaccctgcgcgcgctggaaaacgccctgctggagttcccgggctgtgcgatggttatctcgcacgaccgttggttcctcgaccgtatcgccacgcacatcctggactaccaggatgaaggtaaagttgagttcttcgaaggtaactttaccgagtacgaagagtacaaaaaacgcacgctgggcgcagacgcgctggagccgaagcgtatcaagtacaagcgtattgcgaagtaatgcgtaaaatgccgggtgcggcgcgccagcatcgcatccggtattagttaaatgattagtccccggaaaaaggcagaattttctttaagcgtattagctcagatgcggactgacacctcaaatcaagcgggaactcatggttcccgcttaacgttttattcaccgcgcaggatctggcggaaatgggaaaccagcggacgttggttggctttatgccaggctgcccataattgcgttgaataattcatccacggcaattcacgtaataccaccccttccggcgcattatgacgcagactatgttgaattaaggccagacctaatcccgcagcgaccaaacctaatgccgtgaggggttcacccgcttccaggcgaatatcaggattaaacccggcgttaacacaggcggcgacaaaatgatcgcgagaatgcgcatcgtcgttatgaatcaccgcaatccactgctcatcgccaagttgtgacgcgacaaggttttcctcctgcgccagaggatgattttgcggtaaggccaacaacattcgatcatccagaacctgaatatattccagatcctgctcgctgtcggtgggcggcgtgtcgaccagagaaaaatcgagactgcgctggcgcaggccttcaatctgggtagccggtggttggctgtaaagtgcgatatgcacattcggacgcgatacacgtaacgtacgtagcgccgtagaaagcacaccggaatgcatggcgttttcgatatagccaatacacaagccaccatcttccccccgtcccaggcgtttgcctaacgactccaggcggttggcgtgtgtcagcaacgaacgtgtttcggcaaggaatgtctgtccatcagcggtcaggcgaatgcgctgctgattacgctcaaacagcgtcagccccagccgttcttccagttgtgcaatctggcggctcagcggtgattgcgagatatgtaatcgctcggctgcgcgtcccacgtgctcttcttctgcgaccaccacgaagtacttcagttggcgtaaatcaatcatgttagacctcaaaggacttaagtcagacgaattatgtcctatcaagtcacaacctcgcaaggtattgtgatccacgtcacagggcgatagcaaaaaaacgccctaacccaaaccgaataattgaggacatcttatgagcatcaaaaatttacttcccggcaaaattggcttaggtggcgcaccactcggcaacatgttccgtgccattccggaagacgaggcccacgccaccgtgagcgaagcctggaacctgggcgtgcgttactttgataccgcgccgctgtatggctctggcctttctgaaatccgcatgggtgaagcgctgtctcagtatccacgcgatgaatacgttctgagcagcaaagtcggtcgcatcatgctggacgaaatggaagatccggcaaaacgtgatttcggtgaaaaaggtggcctgttcgaacacggcctgaaaaacaaaattctgaatgactactctgctgacgccacgctgcgctcgattgaagacagcctgaaacgcctgaaaacagaccgtctggatattgtctggatccacgacccggcacaggacttctacggtgacagctggctggaacagttcaacatagcccgtaccggtgcgtttcgtgcgctgacgcgtttgcgtgacgaaggtgtgattaaagcctggggactgggtgtgaatcgcgtcgaaccttgcgaactgacgctggcgctggacgaaccgaagccggatgcgttcctgctggcggggcgttattccctgctggatcacgaacgtgcgctgcaacgcctgatgccagaagcactggaacagaacgtggatattgttgtgggcggtccgtacagctctggcgtactggcaggcggcgagcactttgaatatcagaaagcttctgcggccatccagcagaaagtggcgcaaattaacaccattgccacacgtttcaatgtgaacgttaaagcagctgcgctgcagttcgcgctggcaaacccggccgttgcggcggttattcctggctccagccgtcctggccgtatggcagaagatctggctgcactgaatgcgcctgttccggctgaattctgggcagaaatgcgccgtcaaaatctggttgcggaaaacgctccgctgccgacccgttaatcaacctggtgagaaaacgatgaaactggatctgacaggtaaagtcgcggtggtcagcggctcaacctccggcattgggcagggtatcgccgccggactggcaaaagcaggcgcaacggtggttgtcgtcggccgtaaacagagcggcgttgatgacgccatggctgcgattgcggcacaaactcccacggcgtcactgcgcggcgtggtggccgatctcagcaccgaagacggcgtgactgcgctgatcgctgcagtcccaacggctgatgtgctggtcaataatctgggcattttcaacgataaagatttctttagcgttccggatgatgagtggatgcacttctataacgtcaacgtcctttccggcgttcgtctggcgcgtcactatgcgccaggcatgacggaacagggctgggggcggattatctttgtctcgtccgaatccggcgtggcaatccctggcgacatgatcaactacggcgtcaccaaagccgcgaatctggcggtctctcatggtctggcgaaacgactggcggggaccggtgtgaccgtcaacgccattctgccagggccaacctttaccgatggcctgaaagagatgctggcggatgccgctgcgcagtcgggacgcagtgcgcgtgaacaggccgatgagtttgttaaaacctcgcgtccgagctccatcatccagcgtgcggcagatgtggaagaagtggcgaatctggcggtttatctcgcgtcaccgctttcctcggcaaccacaggggcagccctgcgcgtcgatggcggcgtcgtcgacaccctaacaatgtaaccctataaattaagagaaaattatcatggctaaaacaactgtatcgatcgaaattccggcttctgccgacgccgtatggcaattgatgggcggctttgatgcgctgccagactggctgccgttcatcccgaaaagcgtagtgacagaaggcggtcgcgttcgttcgctgacaacctctgacggcggcactgtggttgaacgtctggaagcgtttgataaccgtcaacgcagttatacctattccattattcaggcaccgttcccggtggtggattacctctccaccattaccgttcatgaaaccgccgacagccaggtttctcgtgtggaatggttcggtgaattcaccccggtgaatgtgacgaacgaagaggccgaagcgctgtttaccggcatctatcgggatggtctcaaggcgctgaaggacaactttgttgcctgatgcaatcgacaggcgtcggaacgtccggcgtctgattattaacaaaatcagaatagtctattgtcatttgtatcatttatgttatcaggcagcaggcgtattctatccccatcgcgttaataaacgccaaacaattaagacactctggaatataaacatgaaaacgatcatcgcaatttttacagcttctcttttctctgtcgcggcgtttaacgcatcggcgcaaagcgtaacagcaaccggtacaacactggattctgcggaagcagttattgcgcagaaagcgaaagagataaacgcctctgaatacaaaatcaccagcgctcgcatgggcaataccgtcaccatgagtgccgaactgtacaaataaccgcgcaagggacccattacgtaatttgctaaatatgcgctgaatgcgttgccattaaaaaaccgtattgtaatgccaccgatgacgcgttcccgcgcgggtgacgttgcgactgacataatggcggactattacgcgcagcacgctagtgcaggacttatcatcagcgaaggtacgcaaatcagcagaagcgctgcgcataattttccacggcacgctgatttactccggtaaatacaccaaagcgcgcgccgaagcggactgtcagatttgattgcattctggctacgcaactggtcggttggagtatgaagttgctcacgaatagccttagcatctgcaatttcgtagcgggtcacccgtgcaggttctttctaatctcaacagcctcttccagagagtttttcaactcatcaaaaaaactcaatttatacctcgcctttgagccgtttcgtcacggttatctctgctcgcccatcatctcccgcaccagctccacacagcgcaggaaacggctgtcgtaatcgtcctcttcaacacgcacaaattcgatattgttctcttccagcatctccaccagcaagttctggaactctttgcgatccaccgaactaccgaggctgcgtaaaccatccgccacccacggcgtgttgttctccagcaagataaccagatcaaaacggtattcatcaatcagcgcctgcacgaacggatgctcacgcccttcgtactttttgcagaacgcctgggtagtgacaaaatcagtgtcgataaacgccactttattggcgtatttcactgcaaaatcaatatattgcgcgtgtcctagcgcgattttatcgtagtcggaatactgcaatgcgatctcatcaccgccaaggtgtgaaaagacataatcgcgaccatattcccacgcactggtggtattgaagatattggcaagtttgtttaccagggtggatttaccgctcgactcgccgccaaggatcgccacggtacgcacaaagaacggcttcacttcggtgggaatatattcccagtagcggaacgggttttcgcggatctgcgcaccgctgatactcataaaggtgcgtttcggatcgaccagcaccgtttcgatccccagatgttccatatactgtggcgcatcggcttcttccgaggtgtagatcaggtccggctggatccccttttcagccataaactttttgatgccgttgctccatacatcccagccgtgcggatatggctccatgccctcttcattgaaagcatgaatacggatatttttctgatatttaaaggtttgcaataaccagcgcagacgatccggcaccgtgggctgctgcgacatggcgctgtcttcaaacaacgcacggtcacgggtatcgtcaaagcccataatgatatgcaactcgtcaacctggctacaggcgcgctggataaggtagatatgtccggtatgcaacgggtagaacttaccgaataccacgccaatggttttcttttggcggggaaactcaagccccaaaaaacggtgcaatgcctccagtttttgcgcgctggggcttttaattttggcattcagtaactggcttaaataccctttggtcataccgctggcatcagctacctgctgtagcgtgcagccctgttgcttgatggcagttttcaggtaatcaaatgacgacatatctccctccgtatctctcattataagtcgtcgaacacgctaagcgcgtcggagagttttttaacgccaaaaatctgcatcccttccggcgcttttttcggcacattagccgccggaacaatcgcccgccgaaaaccgtgtttcgccgcttcagagattcgttcctggccgctgggcaccgggcggatctcccctgccagcccgacttcaccaaacaccaccagatcctgtggcagcggtctgtcacgcaggctggaaaccatcgccagcagtaacgctaagtcggcgctggtttcggttaccttcacgccgccgaccacgttcacaaacacatcctgatcggccatttgcagaccaccgtgacggtgcaagacagccagcaggattgccagacggttttgctccagccctactgcgacgcggcgtggattcgccatcatcgagtgatcgaccagcgcctggatctccaccagcagtggacgcgttccttcccataccaccatcactgagctaccggaggtcacttcatcaccgcggcttaaaaagatggcggaagggttgctaacttcacgcagcccctgttcggtcatcgcgaagacgcccagctcattcaccgcgccgaagcggtttttatggctgcgcaaggtgcgaaaacgggagtcggcatcgccatccaaaagcaccgaacagtcgatacagtgttccagcactttagggccagccagcgagccatctttggttacgtgcccgaccatgacaatcgccacgccgcgcgttttggcgaagcgcgtcagataagccgccgtttcacgcacctgcgccacgctaccaggcgatgattgtacatccgccatatgcatcacctggatcgagtcaattaccatcagcttcggttgctcttcttcggcaatcaggcagatctgctcgatgctggtttccgacagcatattaagattgtcagtcggcaggccaaggcgatgagcgcgcattgccacctgttgcagcgactcttcgccggtgacatacagcgttttcatctgctgcgccagtttgcacagcgtttgcagtagcaacgtggatttccccgcaccagggttaccgccaatcagaatggcacttcccggcaccacgccgccgcctaatacgcggtcgaactctttaaatccggtggaaaaacgcggcagctcttcaaggctgatgtcggaaagtttctggacttttgccaccccggcgctaccggcatagccgctgagacgctcgttacgcgccaccgttggcgacgctgcaagacgcacctcggtgatggtgttccaggcatgacaggcactgcactgcccctgccagcgcggataatcggccccgcattcattacaaacaaaggcgcgttttggagcttttgccacgatgtacctcgttaatgctgtgccgcccgcaggatgacgggcgggcaattacttctgattcaggctgccggagaggatgcagaatacccccatcaggtcagcgtgacggatggtgacttccgtcttttcattcacttttggcttggcatggtaggcaatccccagccctgccgctttgatcatcggcaggtcattggctccatcgccaatcgccacggtctgcgccagcgggatttcatactcctgcgcgaggcgggtcagggttttcgctttatattgcgcgtcaacgatgtcgccgatcacattgccggtaaatttaccgtccatgatctccagttcattggctaccacggctgtcaggcgcagcttgtcgcgcaggtattcagcaaagaaagtaaagccaccggaggcaatcgccactttccagcccagcgtttccagcttgagtaccagctgcgttaagcctggcatcagcggcagattttcacgcacctgttgcagaatattggcgtcagcgcctttcagcgtcgccacgcggctgcgcaggctggcggtaaaatcgagttcgccgcgcatcgcccgttcggttacctccgccaccatctcgcccgttccggccagtttggcaatttcatcaatacattcaatctggatggcggtggaatccatgtccatcaccagcaaacccggcgtgcgcaggtgtgggattttccccagcggcgcgacatccagttgcgcttcatgggccaggcgcgtagcccgcgcggtgagtgaacctgccagacgaatcacctgataatcttccacgcaccaggcggcaacaatcaccatcgccgcgcccagtttgctctggtattgggtcagacgttgtttatccagcccacgaccatacagcagccagccgctacgacctgcgtggtaatccagtggcatcacttcatcaccacttaatgaaagaggcagacccggccataaagagacatcttcaggcaggtcgcaccaggtaatgttaggcattaaggctcctgtaaaatcgttcgaagcagggaaaataacgcatgaggctaccttgtatccattgcttctggcaacattaagtctcaaattttcaaagggtggaagatggctcgcacaaaactgaaattccggctgcatcgggcagtgattgtcctgttctgtcttgccttgttagtggcgctgatgcagggggcgtcatggtttagtcaaaaccaccagcgacagcgtaatccacagctggaagaactagcccgcaccctggcgcgtcaggtaacgctgaacgttgcaccgctgatgcgtaccgactcaccggatgaaaaacgtattcaggcgatcctcgatcagttaacggatgaaagccgcattctcgacgcaggcgtatatgatgaacaaggcgatcttatcgcccgttctggtgaaagcgtcgacgtgcgcgaccggctggcgctcgacggcaaaaaagcgggcggctattttaaccagcagattgtcgaacccattgcgggtaaaaacggaccgctcggctatctgcgcctgacgctcgacacccatacgctcgccaccgaagcccaacaggtggataacaccactaacattttacgcctgatgttgctgctctcgctggcaatcggcgtagtgctgacccgcacgctgctacagggtaaacgcacccgctggcagcaatcgcccttcctgttaaccgccagcaaaccggtgccggaagaggaagaaagcgagaaaaaagagtgacccattactacaagaaaggaaatcgttatgtccacattacgcctgctcatctctgactcttacgacccgtggtttaacctggcggtggaagagtgtatttttcgccagatgcccgccacgcagcgcgttctgtttctctggcgcaatgccgacacggtagtgattggtcgcgcacagaacccgtggaaagagtgtaatacccggcggatggaagaagataacgtccgcctggcgcggcgcagcagcggtggcggcgcagtgttccacgatctcggcaatacctgctttacctttatggctggcaagccggagtacgataaaaccatctccacgtcgattgtgctcaatgcgctgaacgcgctcggcgtcagcgccgaagcgtccggacgtaacgatctggtggtgaaaaccgccgaaggcgaccgcaaagtctcaggctcggcctatcgcgaaaccaaagatcgcggcttccaccacggcaccttgctgctcaatgccgaccttagccgcctggcaaactatctcaatccggataaaaagaaactggcggcgaaaggcattacgtcggtacgttcccgcgtgaccaatctgaccgaattgctgccggggatcacccatgagcaggtttgcgaggccataaccgaggcctttttcgcccattatggcgagcacgtggaagcggaaatcatctccccggacaaaacgccagacttgccgaacttcgccgaaacctttgcccgtcagagtagctgggagtggaacttcggtcaggctccggcattctcgcatctgctggatgaacgctttacctggggcggcgtggaactgcatttcgacgttgaaaaaggccatatcacccgcgcccaggtatttaccgacagccttaacccagcaccactggaagccctcgcaggacggctgcaaggctgcctgtaccgcgctgacatgctgcaacaggagtgtgaagcgctgttggttgacttcccggaacaggaaaaagagctacgggagttatcggcatggatagcgggggcggtacggtaactcgctcattaaaatatccagggaaggaaatatgatcgatctggaaaaccaggaacgggaggttatcaatttaatgttcagccagggtatatcctggctagccgccgtgcgtatcaggcataaattatcgcttgctgaagtaagtaaaatgttaggtatctcgattaattctctaaaacggatcgaaaagacggaacggcttagctcaaacatcaaaagaaaatggcaggaatttatggttgtccaccagagttgctgatatacccttactggatgacggctgaacataaatgaatagattcatgaatggattttattttctatccatatgaaaaataatagtaaatctataaatcagtcgctattgatgaatagatactaaaaagccggagcagtctcccgttccggcttcacaaggcaatcgcctttcagcgaaacacaattactctttatcgcccagcagaacggattccagtgcgattttgatcatgtcgttgaaggtggtctgacgctcagcggcagtggtctgctcgtgagtacggatgtggtcagacacggtgcagatggtcagggctttcgcgccaaattctgcagcgacgccgtagataccagccgcttccatttccacgccgaggatgccgtatttttccatcacgtcgaacatttcgccgtccggagagtagaacaggtcagcggagaacaggttaccaacgcgagcatcaatgcccagtgctttagctgcatctactgcgttacgcaccatgtcaaagtcagcgatagcggcaaagtcatggtctttaaaacggatgcggttaactttggaatcggtgcaggcacccataccgataacgacgtcgcgcagttttacgtgtggcagaacagcgccacaggagcctacgcggataattttcttcacgccgaaatcggtgatcagttctttggtgtagatggagcaggacgggatacccataccgtgacccattacggaaattttgcggcctttgtaagtaccggtgaagcccagcataccgcgaacgttgttcacttcacgggcatcttcaaggaaagtttcagcaatatacttcgcacgcagcgggtcgcctggcatcaaaactacgtcagcgaaatcgcccatttctgcattaatgtgtggggtagccattgttttatcctttttgtgacataacaaaggcggagtcaacgctccgcccaaatccatcagaacatggctttgccatattccatatcagaagtaccaaaatattttgccagagtctggccgatatccgcgaaggtttcacggtgacccagtgagcccggttttactttcgggccgtaaaccagtaccggaatgtgttcacgcgtgtggtcagtaccggtccaggtcggatcacagccgtggtcagcggtgaggatcaggatgtcgtcatcgcgcagcagagacatcagctccggcagacggcggtcgaacagttccagacccgcagcataaccggcgacgtcgcgacggtggccccaggaagagtcgaagtcaacgaagttggtgaagacgatggtgttatcacccgcttctttcatctctttgatggtggcgtcaaacagcgcgtccaggccagtcgctttcacttttttggtgataccgcagttggcgtagatgtctgcaattttaccgacagaaaccacctggccgtgtttttcatcaaccagtttctgcagcacggtcggtgctggcggttcaacggccaggtcgtgacggttaccggtacgctggaagttaccggctttgtcgccgataaacggacgagcgataacacgaccgatgttgtagccgccgttggtcagctcttcacgggcgatttcgcacagttcgtagagtttatccagaccgaaagtttcttcatggcaggcaatctggaacacggagtcagcggaggtatagaaaatcggcttgccggttttcatgtgctcttcgcccagctgatccagaatgaccgtaccggaagagtggcagttaccgaggtaacccggcagattagcgcgttcgaccagtttatccagcagctcttgcgggaagctgttttcgtgatcggagaagtatccccactcaaacagaaccgggacaccggcgatttcccagtgaccagacggggtatctttaccggatgacatttcgtgcgcccatgcgtacgcgccgataacttcagcgttgccgtccattcccgccggaatgaaaccggtagaaccttcgtgtgctttcgccagccccagacgggtcagatttggcagattgagcgggcctttacgaccgttatcagcttcgcctttggcacaagcttctgcgatatgacccagggtgtcagccccgacgtcaccaaagcgttctgcatcttctgtagcgccgatgccgaatgagtccagcaccataataaatgcacgtttcatatgttctccgtactcagtgcttcaaatttaaatgatcagatcagtataccgttattcgctgatacggcgatagacagttggtgtgctttccggtgctttatcggcaagtttaattgccgctttcaccgctttcgccgcttcctgccagctgttttcgtctttcgcgtggataaccgccagcggacgctgaccgtctacctggtcgcccagacgcgccatatcagtaaagccgacgctgtaatcgatggtgtcagatgcctgacggcgtccgccgcccattgcaaccactgccatccccagcgcgcgggtatccatttcactgacaaaaccttcggtatcagcatagactgctttcgtcagcatcgctgtcggcagatacttcgcgtagttctcaacgaagtcggttgggcctttttgtgccgctaccatacgaccaaagacttctgccgctttaccgttgtccagcaccgcctgcaatttcgcgcgtgcttcggcgtcatctttcgccagtttgccggagatcagcatctccacgcacagcgccatcgtgacatcaaacagacgcgggttacgatattctcccgtcaggaactgcactgcttcacgaacctcaaccgcgttacctgcactggaggccagtacctgattcatgtcggtgagcagcgcggtggtgcgcacgccagcgccgttagccacgccaacaatcgcttcggcaagggcttcagagagttcgtaggtcggcataaacgcgccgctacccactttcacgtccatcaccagcgcgtccagaccttccgccagtttcttcgccagaatcgaggcagtgatcagcgggatggagtccacggttgcggtaatatcacgggtcgcgtagaaacgtttatccgccggagccagtgagctggtctgaccgataatcgccacgccgacgtctttaataatttcgcggaaacggttgtcatccgggaaaatgtcgaagccaggaatggattccagtttgtcgagcgtaccgccagtatgaccgaggccgcgaccggagatcatcggaatatagccgccgcaggctgcgaccatcggccccaacatcagcgaagtcacatcgccgacgccaccggtggagtgtttatcaacaattgggccattcagatgcaggcttttccagtcgagaacggttcctgaatctcgcatcgccatggtcagcgagacacgctcaggcattgtcatatcgtggaagaaaatggtcatcgcgagggcggcaatctgcccttcggagatagtgttgtcgcgaatgccgttgataaagaaacgaatttcttcatcgctcagcgcatgaccatcacgttttttacgaataatttcttgtgcgagaaacaaggtaacctcccgtggaataagtttgaaggtgttgttgccagatggcggatgttgttattgcctgatgctgaccgattcttatcatgcctacacggcactcgcccgtaggccggataaggcgttcgcgccgcatcaggcagcactgctgactgcctgatgcgacgctgacgcgtcttatcaggcctactgggggcatccggcatccaccctctggcaaaaggcagcttagtagctgcttgcgctcttaccgtcgccgtggcccagcgctttcagcaggcttgccagcaggctggaagcgccaaagcggtagtgacgcgcatcagcccagtcagcgccgaacagttcatctgcgatggcgagatatttctgcgcatcttccgcagtacgcacgccgcccgccggtttgaaaccaacggttttttctacgcccatgtcgcggatcacttccatcatgatgcgcgcgctttccggcgtcgcgttcactgccactttaccggtagaggttttgatgaagtcagcacccgctttgatagagatttcagacgctttgcggatcagcgcttcgtctttcagttcgccggtttcgatgatcactttcagcagtacgttagccgctgcgcaagcctctttacaggctttcaccaggtcaaaaccaacctgctcgttacccgccatcagcgcgcggtacgggaacaccacgtcaacttcatcggcaccgtaggcgattgccgcacgggtttctgccagcgcgatgtcgatgtcgtcgttaccgtgtgggaagttggttaccgtagcgatacggatttccggggtaccctgctctttcagcgttttgcgagcaatcgggataaagcgaggatagatacagatagcggcggtattgccgaccggagttttggcctgatgacacagggcgatcactttctcgtcggtgtcgtcgtcattcagggtggtcaggtccatcaatttcagtgcacgcaggctgcttgctttcagatcagtcatttcattctcctggcttgtcgccaataaaattcaccttgcgagtttgttagtattctaacatctactccgcaacacacttcgatatacatcacaattaaggaaatctacttacaagtttgcatcactgtaatgcgatctggttcaaataattcactttcaaatgaatgcgtcagtggtggcaaacgcatcaggatcaaagtgaacatcacgaaacttcttacaatggcgcatcaccttcggcataaaaggaaaagaagatgcccacttctcatgaaattgcactgcaacaacgttgccagcaaattgtcaccagcccggtacttagcccggagcagaagcgccattttctggcgctggaagcagaaaacaatctgccttatccgcagcttcctgccgaagcccgccgcgcgctggatgagggtgtaatctgcgatatgtttgaaggtcatgcgccgtacaaaccgcgctatgtcttacccgattacgcccgttttctggcgaacggttccgaatggctggagctggaaggcgcgaaagatcttgatgatgcactctctctgctgaccattctttaccaccacgtaccatcggtcacatcgatgccggtctacctggggcaactggatgcgttgttgcagccgtatgttagaattctaacacaggacgagatcgatattcgaataaaacgtttctggcgttacctcgacagaaccctgccagacgcctttatgcacgccaatatcggcccgtctgattcgcccatcacccgtgcaatcttacgtgcagatgcagagctgaagcaggtttcaccgaacctgacctttatctacgatcctgaaatcacccctgatgatctgctgctggaagtggcgaaaaacatctgcgaatgtagcaaaccgcacatcgccaacggtccggtgcatgataaaattttcacaaaagggggctacgggattgtgagctgttacaactcactgccgctggcgggtggtggcagcacgctggtacgccttaacctgaaagccattgccgagcgcagtgaatcgctggatgacttctttacgcgcactctaccgcactactgccagcagcagatcgccatcatcgatgcgcggtgtgaattcctctatcaacaatcacacttctttgagaatagcttcctggtgaaagaagggctgattaaccctgaacgttttgtgccaatgtttggcatgtatgggctggcggaagcagttaacttgctgtgcgagaaagatgggattgccgcgcgctacggtaaagaagccgccgcaaatgaagtgggttatcgcatcagcgcacaactggcggagtttgtcgccaatacccccgtgaaatatggctggcaaaaacgcgccatgttacacgcacagtcggggatcagttctgatatcggcaccacgccgggcgcgcgtttgccgtatggtgatgagccagatccgattactcatctgcaaactgtcgccccgcatcatgcttattattattccggcatcagcgacattctgacgctcgacgaaaccatcaaacgtaacccgcaggcactggtacagctttgcctcggtgcctttaaagccggaatgcgtgaatttaccgccaatgtcagcggtaacgatctggttcgcgttaccggttatatggtgcgtttgtcggatttagaaaaatatcgcgccgaaggttcacgcaccaacaccacctggctgggagaagaagccgcacgcaacactcgtattctggaacgccagccgcgcgtgataagccatgaacagcagatgcgctttagtcagtaagattatccccttctcctgcgttgacgggccaggcagtcgtctggctctgtttttgcagggctgcaatctgcgctgcaaaaactgtcacaatccgtggacgatgggacgctgcaatgactgcggagagtgcgtgccgcagtgtccgcatcaggcgttgcagattgttaacggcaaagtggtgtggaacgctgtggtttgcgagcaatgtgatacctgcctgaagatgtgtccacaacatgccacgccgatggcgcaatccatgagcgtggacgaggtgcttagccatatccgcaaagcggtgctgtttattgaagggataacggtaagcggcggcgaagccacgacccagctgccgtttgtggtggcgttgtttactgccatcaaaaacgatccgcaactgtgccatctcacctgtctggtggacagtaacggtatgttgagcgaaaccggctgggaaaaattactcccggtgtgcgacggcgcaatgctcgatctcaaagcgtgggggagcgaatgtcatcagcaattaaccggacgcgataatcagcagattaagcgcagcatctgtttgcttgccgagcgcggcaagctggcggaactgcgtttgctggtaatcccaggccaggtggattatttgcaacacatcgatgagctggcggcgtttatcaagggacttggcgatgttccggtacgcctgaacgcgtttcatgcccacggcgtgtatggcgaggcgcaaagctggccgagtgccacgccggaagacgttgagccattggctgatgcgttaaaggtgcgcggggtgagccggttaatatttccggcgctatatttgtgacatgccggatacggcctatggttcggcacagacttgtaggtctgataagacgcgtcaagcgtcgcatcaggcattgtgcgccaactgccggatgcggcgtgaacgccttatccggcctacggttcggcacagacctgtaggcatgataagacgcgtcagcgtcgcatcaggcattgtgcgccaactgccggatgcggcgtgaacgccttatccggcctacggttcggcacagacctgtaggcatgataagacgcgtcagcgtcgcatctggcattgtgcgccaactgccggatgcggcgtgaacgccttatccggcctacggttcggcacagacctgtaggcatgataagacgcgtcagcgtcgcatctggcattgtgcgccaactgccggatgcggcgtgaacgccttatccggcctacggttcggcacagacttgtaggcatgataagacgcgtcaagcgtcgcatcaggcattgtgcgccaactgccggatgcggcgtaaacgccttatccggcctacggcacgttaaacaacgcatatgtgttattaagcaacacttcggcaatctcatccgcaggttccgggcgtaactcgcaaagcacagcaaacaccccggcggcctgttccgggcggttaggctgcccctgaaaaccgttgagcggcatatccggcgcgtcggtttccagcaacaacgatgccagcggtaattttgcgatgacatcgcgggttttactggcgcgtggataggtgatagtgccgcctacgccaattttgtagcccagctgtacaaaccgttcagcctgttgcaggctgccggaaaaaccgtgaaccacgccagtgcgcgataaatcgtggcgtttaagatgcatcgccagtttgtcgtgcgtgcgccgtgaatgcaggatcaccggcagatcgtagcgtttcgccagtttcagttgttcgtcgagtaaccactgctgcctctcaaattgcggatcgtcgccgaagagatccagaccgatctcccccactgccaccaccttcgccggacgcctttccagcgcctgctgtagctgatcaagagacacatcgctatgtttttctaacatccccggatgcaaccctaacgaggcatacagcggttgataattttccgctaatgccaacacacgggcaaaatttgccgcctctgtcgccggaacaatgatcttgcctacgcccgcttgtgccgcgcgttgcaggctggcctcttcatcgccactaaaaggcgggaaatcaaaatggcagtgggtatcgataaaacggcaaatcaagccagatcctcattgttaaatgtcgggtcgttcgcctgcggagcgtcgctcacttcggcaaccagcgtatcgttggcgactggcgcaggcggaatgacaatcgattccggcgtcaccactggcaccagatggcgggttagcggcgctttttcagttaatagcttgccaaccgttgccaggaaataacgaccgcataaacgcccaagtttatagtcttcacgcagcgccggaatccgactgccaagcgcgatactatgcaatggcttcggcggataaatttcgaatatccgcagtttgcccggtggtttctcaataaattgctgaatgtcacgatagctggtttcatgatgctgcaccagattgaccagcggctgcaggctactgtcacccagccagcgttccatgcgtttgaaccactgcggcgtgtagtacatttgcgacggcacggtgcggatgacgaccaacgtttttgctccctgccttgccgcctctttaaccggaatcgcatcactgatcccgccatccaggtagttaatgccttccagcgacactccgctacgataaaagccaggtatcgcactggaggcgcgaatcacatccagccagttttgtttggttggtaaaaagtaattcggcgcatagtcatcctgacgacaggcgcacatataaaacgatttgccgctgtcaaacaaccgcgcggcggtatccatttgcaacggcatctggcttgcagtggcctccaccagccagtcgagatcgataagatttcctccacggacaaagcgcaatggatcgaaaaattcgcgttttgtggtatagcgcatgatgactttgcgcgcgtaaccgggctgattgcagatatacgccgagaggttctgcgccccggcagatgtgccgagataaagatcgaaaggattaaactgcgcgcgcataaactcatccagcacgccagccgtgaaaattccacgctgtccgccgccttcgcacaccagagctattcgtccaggctggaacggccttagcgacaacggcgcaatattaccaagcgttacaggtattcgctgccccacctctgccttcctgtttttgttgtgaaagaatgacaaagtaacgcaatttattattcgctaaaaccgcaaaagccagtccgctggactggctttggataaaattttcttaatggtctgaaatctagggtcgttttcggcccatgaacaaactcaccaggaacagaataatcccgacgacaaagacaattttagctgcgcctgcagcggtaccggccagaccaccaaacccaagtgcggcggcgattaacgcgataaccagaaatatgatgccccaacgaaacataagcgtctcctttaccatagttaatgtcaccgcttgatatgagcgtgaaaatcactcaatgcgatatttttagtgtggtgcacatcgcgcctcccgacaaagttcgggaggacgaattacgacgaattacttagttttcagatcatttttaacgcttttcacaccatctaccgctttggcgatactttcagcacggtcgctctgtgcctgggaatcgacggtaccggagagctgaaccacgccgtcggtggtttcaactttcacatgacgggaagggacgatatcgtccgccagcagtttggctttgatttcactggtggtggcggtgtcacccgcgtagcccttcacagagccttctttagcgtcgcgaacgtgcagtttgtcgctgacagaggtcaccccttcaacgcctttcgccactttcactgcctcttcggcctgggcctggctttcaacgaaaccgctcagggtcacgactttttgatcggttttgacagagatatcggtgctcttgatgttgtcatgatccaccagggccgccttcactttcgcggtgatggcgctgtcatccatgaaattaccgactttattcatagagctatcgactttttgccctgcgctttcattggtagtctgcgcgttgttttccgcgtaggcagagccggtcgcgacggcagaggtcaacattacagccagcagagttttcgaaatcttcagtcttgtcatagtcatcgatttattcctgtatgtttgctcgtaatttgagcctggcaacacgaggttgcattgctgaatagggagagacttcaccctctacagaagtcaatggtcgccatcacaaaagcgatgggtgatgaataacgaccattacagcctctgaatcagttattaatatcggtagaatgacaatcgacggctttagatactgatatctacgcattgaacggtatttaacgccgtcagaaatgtcattactttgttaaatatagatcacaattttgaaaccgctcgggatatcagctaaaacataagcaaaagtgaatgttttaagaacattccgtaagcggctaataaggaagggaaattgacagggcgcagcggctaccgcgccctggaggcaagaattaatgctcgcgggtctggtggaactgaacgtccggataacgttcctgcgccaggcgcaggttgaccatgctggtagcgatgtaagcgaggttatcgccgccatcaagcgccagttggctttcgttcttacgcttgaactcttcgaatttcttcgcgtccgcacattctacccagcgggcagtggcaacgttgactgactcatacactgcttcaacgttgtattcgctcttcagacgcgctaccaccacatcaaactgcagcacaccaaccgcaccaacgatcagatcgttgttggagatcggacggaacacctgcactgcgccctcttcggaaagctgtaccagccctttaagcagctgtttttgcttcagcggatctttcaggcggatacgacggaacagttccggcgcgaagttcggaataccggtgaacttcatcatctcaccctgggtaaaggtgtcgccgatctgaatagtgccgtggttatgcaggccgaggatatcgcccggatacgcttcttcaacgtgcgaacggtcacccgccataaaggtcagcgcgtcggagatcaccacatctttcgcagtacgcacctggcgcagcttcatgcctttttcatatttaccggacaccacacgcataaacgccacgcggtcgcggtgtttcgggtccatgttggcctgaattttaaatacgaagcctgtaaatttgtcttcgctcgcctctacggtacgggtatcagtctgacgcggcatcggcgcaggggcccactccaccaggccatccagcatatgatcaacgccaaagttacccagcgcagtaccgaagaataccggagtgatttcgcccgcaaggaacagctctttgtcgaactcgttagacgcgcctttcaccagttccagttcgtcacgtagctgctgtgccagatcttcaccaaccgcagcgtcgagatccgggttattcagccctttaacaatgcggacttcctgaatcgtgtggcctttaccgctctgatagagataggtttcatctttataaaggtggtaaacgcctttaaacagcttgccgcagccaatcggccaggtgatcggtgcgcagccgattttcagctcgttctcaacttcatcgagcagctccatcgggtcgcggatatcacggtcaagtttgttcataaaggtgaggatcggcgtgtcgcgcagacgggtaacttccatcagcttacgggtacgatcttcaacaccttttgcagcgtcgataaccatcaggcagcagtccaccgccgtcagggtacgataggtatcttccgagaagtcttcgtgccccggggtgtcgagcaggttaaccaggcaatcgtgatacggaaactgcatcacagaagtagtaatggagatcccacgctgcttttccatctccatccagtccgacttagcgtgctggttggaaccacggccttttactataccggcggtctgaatggcctgtccgaacagcagcaccttctcggtgatggtagtcttaccggcgtccgggtgagaaataatggcaaaagtgcggcgcttcgccacctcttgcaaataaggagacaacgtcataattctttcttcttgagtaagcggcatcgcgccgcgcttgttgaaaacgaaaaattgcggctattttacccatcaacgggggggaggcaatcagtgtttacacaggagctgctccagttcgtgcaacgaagaaacggtccaggtaggcgcgatgccttctggttgctcgcgattgtgcgcattcagccagcaggtcgcaagcccggcgttgatgccaccgagaatatcggactcggcagtgtcgccaaccatcagcacgcgtgaacggtcaggattgcccgcctgttccagcgcataatcgaaaattttcttattcggtttggctacgccaacttcttcggaaatcaccaacaaatcgaaataatcacgcaggcccgtgcgttccagacgcacttgctgcaaggcgctaaagccgttggtgatgatgccgattttggcgttgccacgaatggcgttaagcagagaaaccgcgcccggcagcggcgtacagatttccgccatcgcattaataaaggcttcgttgagtttacccggctcgacgttcagtcgttcggcccagctctcaaaccgcccgtgctgaagctgtaatgaagtgatcgcgccgttttgataatccacccacagtggcttgttaacggcctgatagtcctgaaaatcttcagcggtaaaggtgacgctgtaatcaagaaacatccgctgcaggccggtgaatgagtcaaaggtaaacagcgtttcatcggcatcaaagaaaatccagtcccacttcattattccaccttgtcttacatactgattggcaacgccatgatgatggcgtcttcgcgaccgtccgtggtggggtagtaattgcggcgaatcgtcgcctcgttaaagcctaaactttcgtacagtgcaatggcggcagcgtttgaggcacggacttccagccatagcgtcgccacgccgcgtttttccagttcgtcgatcagatgttccagcagcgcccttcccaatccctgacgctgatagtcaggatcgaccgcaatattgaacaatgtagcttcatccagcaccacttgcgtaatcgcaaacgccgccattttgccgttttgcgttaactgaaagttgagataacgctcgccctggttgctggcaaaggttttttcactccacggaaaggcgtgggcgcgttgttcaatgtggtaagccgctggtaaatcagtcgtttcgagggaagaaatcgtgttcatatgtgcaaatttgttgccataacgcggcgcgtgccgttgggtttgcccgtaattcggtgagcgccggtgatgccacctgagcgccttccagtgatagcggttcgtcagtacccaaccgccagctgttgcagcgactgccttgcggcagcatcgcgattttttctggcgtcagttgcagcacttgatcggggctgacggttaatgcgcgcagaacatcgctcaccagaggatcggtcagggcgggaagatcgtttgccaccatcaccagacggacgtgtgccgggatcgcaatcgcaatctccccctgcaacgcgccagggcgacgcagcgaccactgggtaatgcccagttgctgtaactgccagtctcgtcgggatgtcatagcgaatcgctcctgttgtcaggggcgcaaatatagcaaattcgtcgataccgcgccaacatatggctataatcgccgccagtatcaattgaggagcattccatgtctgcatttaccccggcaagtgaagtcttgctgcgtcacagtgatgatttcgaacaaagccgtattctttttgccggagacttacaggatgacctgcccgcgcgtttagataccgcggccagccgtgctcatacccagcaattccaccattggcaggtgttaagccgccagatgggggataacgcccgtttcagtctggtcgccacggcggatgatgtcgcagattgcaatacgctgatttactactggccgaagaacaaaccggaagcccagttccagttgatgaatttactttctctactgccggtgggcacggatatttttgtcgttggcgagaaccgcagcggcgtgcgcagcgccgaacagatgctggcagattatgcgccgttgaataaagtcgacagcgcccgtcgctgtggcctctattttggtcgtctggaaaaacagccggaatttgatgccgataaattctggggcgaatacagcgtcgatggcctgacagtcaaaacgctgcctggcgtgtttagccgcgacggtctggatgtcggtagccagttactgctctcgacgttaactccgcacacgaaaggtaaagtactggatgtcggctgtggcgcgggcgtgctttctgttgcctttgcgcgccattcaccgaaaattcgtctcactctgtgcgatgtctctgcgccagcggtagaagccagccgcgcaacacttgcggccaacggtgttgaaggtgaagtctttgccagtaacgtcttttccgaggtgaaaggtcgttttgatatgatcatctccaacccgccgttccacgatgggatgcaaaccagcctcgatgcggcgcaaacgctgattcgcggcgcggtgcgtcatcttaatagcggcggcgagctgcgaattgtagcgaacgccttcctgccttacccggacgtgctggatgagacatttggcttccacgaagtgatcgcgcaaaccgggcgcttcaaggtgtatcgcgccattatgacccgccaggcgaagaaaggttaagtatcccgccttatccgacctaccaaacctgcacgttaccccgtaggccagataagacgcgctagcgtcgcatctggcatctgcccccgtatgccgtgtcggatgcggcgtgaacgccttatccgacctaccaaacctgcacgttagcccttcgtaggccagataaggcgcgcccgcgtcgcatctggcatctgcacccaaataccgtgtcggatgcggcgtgaacgccttatccgacctacaaaacctgcacgttagtttcctgatggccatttttccagcaattacacctccggcgataattaactattgacgaaaagctgaaaaccactagaatgcgcctccgtggtagcaattctttttaagaattgatggtatgcgaaggtggcggaattggtagacgcgctagcttcaggtgttagtgtccttacggacgtgggggttcaagtcccccccctcgcaccaaaaaccacgttgatattgctcgcactgggcgaaggtggcggaattggtagacgcgctagcttcaggtgttagtgttcttacggacgtgggggttcaagtcccccccctcgcaccaaacgaggcgatatcaaaaaaagtaagatgactgtgcgaaggtggcggaattggtagacgcgctagcttcaggtgttagtgtccttacggacgtgggggttcaagtcccccccctcgcaccaattatctttacttcctttcttgtttcttccctgatttttcatccctgattcaaattcattatcatcagcatgatgccagcaataagcgccaggcacgatggcagcaaaacgtaatgccgcaactgtttgtgatacagcatcaccggcgtcaatattaatcccatcagaatgacaatccgccactgatccggcgataaatccgcatacatcagccctgcaatcagcaatcccggcagcaacactccccagccactgcccagcgtacgttgcaacatggtttcatctctttcattgataatgataactaatatcatatgataatttttatcatttgcaagccagagaaatcccttgctatcgggtaaacctatcgctaggattagcaatcattatcatttagattactatcccgattatggcctatcgttccgcaccgctctatgaagatgttatctggcgaacgcatctccagccgcaggatgctgggcttgcacaagccatacgggcgacgatcgccgaacatcgtgaacatttgctcgagtttatccgcctggatgaacccgctccgcttaacgccatgacgctggcgcaatggtcatcaacgaatgcgctaagttctctactggtggtctattccgatcatatctatcgcaaccaaccaacgatgatccgcgagaacaaaccgctgatctcactatgggcgcaatggtatatcggcctgatggtgccaccattaatgttggcgctgctgacgcaggaaaaagcattagatgtgtcgccggaacatttccacgttgagtttcacgaaaccggacgcgccgcctgtttctgggtcgatgtgtgtgaagataaaaacgcaacactacattcgccgcagcagcgaatggaaacgttaatcagtcaggcgctggttccggtagtgcaggcattagaagcaacgggagagatcaacggcaaacttatctggagcaataccggttatttgatcaactggtatctgactgagatgaaacagctgcttggcgaggcgacggttgaatcgctgcgccatgccctcttttttgagaaaatgctcacgaacggtgaagataatccactctggcgtaccgtggtactgcgcgacggcctgctggtgcgccgcacttgctgccagcgttatcgcttaccggatgtgcagcaatgtggcgattgtatgctgaaatgaaagcactgccggggaagtaaacccggcatcatgcggattaatagggatgcaacacattacttgcttcgcaatgccgcatacataacagaatatctgcggcctccaacaaccctgcatcagaacttacgcccagtttcgacatcacattaaatttatgtgcacggatcgttttgatattgcgtttaagctgctcggcaatttgtgtcattgagtagccacgcgacataaagcgcaatatttctctctccgtcgggcttagcgttcggctttgattaatgtaccactgattgttcagtcggtcggtcgcctgacgtacaccatttaatgacaaaaagagttcctgatgaaaaatctccagcgttgacgctttacttaatacaccgtccagcggtgatggcgacaatgagccgatcagccgagcttcaatatcatcatccgcaataactaaacgccgggtacgcggaaacttaatcgccagttcagtcaggcaagataatccctctctacgctcacctctcatggcagaaaaagaaaaaatgaccgccgcaaacgagatccgcgacatggcatcctgaaatgactcctgactggtataggtatggagcttataagggttacccgcaaactttctgaataaactctcaataccgatactactcatgacgcatttttctatgagtgcgacatttctcttcttaattcggctgtgttccattctgcggcatctccataaacagaaggcaagttaagttctcttgcaccctgtgcgctatttatccatgcatacatttcagcgttgctgtgaattgccagtcgacgcatcgcactgtttttttgggcgctgatagttttattacttttcttaagcaatgaagctatctggttgatgccccatcctttacctaatagccgcagtaccttgcgctctgaaagagtgagaatgacggagcgatagctaaaatcatgagtttcagtcattgccggagaggtcagcatggcgctgatacgctctgcgtgcgtattgccggaacgtacggtcttgaccagattctcaatgggttcaacatcagacaataacgtcgccgtagggcacataagcagttctactgcctgggaataccaggagcgtgacaccatgaaaacccagtgaatttcccgatattgtgagattaaagaataataatgttcacaaacagaacgtggatcttcactttcaccggctaaatcagcaatgactaatccggaacgacgtaattgtaataaggtaaggtcctccgcagaggcgctggatattatttcatattcagggaagtgagtcctcatgacctcttttaaccctgcttgcataacaggtattttactgataacaattccatttttgcagcatcctggcaacatatttcctccacatccactgtctaaaaattatgatggtttattcaggatattcattccttaaatgtttccagcaaattaatagattaagcgaataaattatccttagcattcactttcatatcagcatactcctgctgcacaacaactccactgcatgtgtcagaaggttagcatcaaatgataacctggtgaaatagcctggagacatttaaaatatctacattaagttgttagaaatacttaatgaaaaacagaattctcattcatttaatttataattaactgatatcccttccagtagaatgcaaaatcacacaatcaatatttattcaataaaatctgatagttttaacttgtaaaaattaaaaaacgcgcccagttatcttttatcctgattcgtaaaggctaaacaataaattcattatagtgataatattcatgtgataatttatttgcgacgagagataattcgctttttatcaccgagcttctcccgataaccaggattaatcagcgcaattttgatcttaacctaccgcaaaacaaccgtgcttcatgatacaaatggattctcattatctgaacaatacgcagcacgtctatgacaaagggcgagttatgcaaactgagcaacagcgagccgtaacacggctttgtatccagtgtggattatttcttttgcaacatggtgcggaaagcgcgttggttgatgagctttcctcacgactgggtcgggcgctgggaatggacagcgtcgaaagttctatctcttcgaacgccatagtgctgacaactattaaagatgggcaatgcctgacatcgacacgaaaaaatcaagatcgcggcattaatatgcatgtggtgactgaagtccagcacattgtgattctggcggagcatcatctgctggattacaaaggtgtagagaaacgatttagccaaattcagccattacgttacccgagatggctggtagccttaatggtcggcctttcttgcgcctgtttctgtaaactcaataaaggtggctgggatggtgccgtcatcaccttctttgccagtacggtcgcgatgtatatccgccagctgctggcacaacgtcatcttcatccacagatcaacttttgcctcaccgctttcgccgccaccaccatttccggtttgcttttgcaacttcccactttcagcaatacacccactatcgcgatggccgccagcgttctgctgctggtgccgggttttccgttgattaatgccgtcgccgatatgtttaaaggccacatcaataccggactggcacgctgggcgatcgccagtctgctgacactggctacctgcgtcggcgtagtaatggcactgacgatttgggggctacgcggatgggtgtgatcgaatttctgttagcgttggcgcaggatatgatcctcgccgccattcctgcggtcggctttgcgatggtgttcaacgttcccgtgcgggcgttacgctggtgtgcgctgcttggctcgataggtcatggttcccgaatgatcttaatgaccagcgggctgaatattgagtggtcaacttttatggcttctatgctggtcggcaccattggtattcaatggtcgcgctggtatctggcgcatccgaaagtgtttaccgtggcggctgttattcctatgttccctggcatatcggcttataccgcaatgatttcggcggtaaaaatcagccagctaggttacagcgaaccgttgatgattaccctgttaaccaactttcttacagcttcatcaattgttggtgcgttatccatcggtctttccattcctggattatggttgtaccgcaagcgccctcgcgtataaaattgcctcgcttaagcacacggatgagagacagcctcctctcctccgtgtgttactataaaagttatctcccttctcgttcatcgttccatatttgagaaacagtatgtcttccagagttttgaccccggacgtcgttggtattgacgccctggtacacgatcaccaaaccgttctggcaaaagctgaaggcggtgtggttgccgtatttgctaacaatgccccggcgttttatgccgtcacgcctgcacgcctggctgaactgctagcgctggaagaaaagctggcgcgtccgggaagcgatgtcgctctggacgatcaactctatcaggaaccgcaagctgctcccgttgctgtacccatggggaaattcgccatgtatccggactggcaacccgatgccgactttatccgcctggcggcgctatggggcgtggcactaagagcgccggtgaccaccgaagaactggcctcattcattgcctactggcaggcggaaggtaaagtctttcaccatgtgcagtggcaacaaaaactggcgcgcagcctgcaaatcggtcgtgccagcaacggcggactgcctaaacgagatgtgaatacggtcagtgaacctgacagccaaattccaccaggattcagagggtaacgatgaaaaacgttggcgacctgatgcaacgcctgcaaaaaatgatgcctgcccatatcaaacctgctttcaaaacgggtgaagaactactggcctggcagaaagaacaaggggcgatccgctccgccgctctcgaacgtgaaaatcgggcgatgaaaatgcagcgcacctttaaccgctccggtattcgtccactgcatcagaactgctcctttgagaactatcgcgttgagtgtgaagggcagatgaatgcgttaagcaaagcgcgccagtatgtcgaagagtttgacggcaacatcgccagcttcatcttttctggtaagccaggaaccggcaaaaaccatctggcggcggcaatctgcaacgagctgctgctacgcggtaaatccgtattgatcatcaccgtggccgatattatgtcggcgatgaaagataccttcaggaatagcggtaccagcgaagaacaactgcttaacgatctgagcaatgttgatctgctggtgatcgatgagatcggcgtgcaaaccgaatcgaaatacgaaaaagtgatcatcaaccagatcgtcgatcgccgctcttcttccaaacgcccaaccgggatgctgaccaacagtaatatggaagagatgaccaagttgctgggcgaacgcgtgatggaccgtatgcgcctgggtaacagtttgtgggtgatcttcaactgggatagctaccgtagccgggtaacgggtaaagagtattaatccccgtttctggcggtatactgcgacacaattccaccttgagtaatgatgatgaaaactgttaaacatcttctgtgctgtgccattgccgccagcgcattaatttccaccggggcacatgctgcgtcatggaaagatgcgctctccagcgccgccagcgaacttggcaaccaaaacaacacgacacaggaaggcggttggtcgctcgcgtcattaactaacttgcttagcagcgggaaccaggccttaagcgcagataacatgaacaatgccgcaggcattctgcaatactgcgcgaagcaaaagctggcttcggtaaccgatgccgaaaacatcaagaatcaggtactggaaaaactgggcctgaacagtgaagagcaaaaagaagacaccaactatctggatggcattcagggtttgctgaaaactaaagatggtcagcaactcaatctggataatatcggaacgactccgctggcagaaaaggtgaaaaccaaagcctgcgatctggtgttaaagcaggggctgaacttcatttcctgaaccgcgaaacgccgcgttttagctgttacccggctgacgcggctctctcctgcccttttccctgctcctggacggttttccccctgttacacgggaagcgaccgtaatcaaaaaagtctgtttataaactaattcctaacaacatcgcatttttttgacactagaattgcagcaatatggccacgccattacattgtgcttctcaaaaagcttaaacgttggctaaacggcccggtttagtgaggatcgcccgttgtcagaactactctctttcgccctttttctcgcctctgtgctgatttacgcatggaaagcgggacgtaacacctggtggtttgcagccacgttaacggtgctggggctatttgtcgttttaaatatcaccctgtttgccagcgactattttactggtgatggtattaacgacgcggttctctataccttaaccaacagcctgaccggtgctggtgtcagcaaatacattcttccgggtatcggcattgtgctggggctgacggcggtgttcggtgcgctgggctggatcctgcgccgtcgtcgtcatcatccgcaccattttggttacagcctgctggcactcttactggcgttgggttcagtggatgccagcccggcatttcgtcagataacggaactggtgaagtcccagtcacgcgacggcgacccggactttgcggcttattataaagagccgtcgaaaactatccctgacccgaaactcaacctggtttatatctacggcgaaagtctcgagcggacctattttgataacgaagctttcccggatctcacgcctgaactgggcgcgttgaaaaatgaaggcctggatttcagccacacgcagcagctgccgggaacggattacacgattgcgggtatggtggcttctcagtgcggcattccgctttttgccccatttgaaggtaacgcctccgcttctgtttccagcttcttcccgcagaacatctgtctgggcgatatcctgaaaaactcgggttatcagaactatttcgtgcagggcgcgaatctgcgttttgccggtaaagatgtgttcctgaagtcgcatggcttcgaccacttatacggctcagaagagctgaaaagcgtggtagccgacccgcactatcgcaacgactggggattctacgacgataccgttctcgatgaagcgtggaaaaagtttgaagagctttcccgctcaggtcagcgattctcactgtttaccctgacagtcgatacccatcacccggatggttttatctcgcgtacctgtaaccgcaaaaaatatgattttgacggtaagccgaatcagtcattcagcgcggtaagttgcagccaggagaatatcgcgacgtttatcaacaaaatcaaagcgtcaccgtggtttaaagataccgtcatcgtcgtctcttctgaccatttagcgatgaacaacacggcgtggaaataccttaataaacaggatcgcaataacctgttttttgtcatccgtggcgacaagccgcagcaagagacgctggcagtgaagcgtaacacgatggataacggcgcgacggtgctggacattctcggtggcgataactatctcggacttggtcgtagcagtttatccgggcagtcgatgtcggaaatcttcctcaatatcaaagagaaaacattggcgtggaagccggatatcatccgcctgtggaaattccctaaagagatgaaagagttcaccatcgaccagcagaaaaacatgattgccttctcgggtagccatttccgtttgccgctgctgttgcgggtttcagacaagcgcgtagaaccgctgccggaaagtgaatactcagcaccgctgcgtttccagctggccgatttcgctccacgcgacaatttcgtctgggttgaccgttgctataagatggcacaactctgggctccggaactggcactttccaccgactggtgtgtctcgcaagggcagcttggcggtcagcaaattgtccagcatgttgataaaacaacatggaagggcaaaacggcatttaaagatacggtcatcgacatggcgcgttataaaggcaatgtcgatacgctgaaaattgttgataacgatattcgctacaaagccgacagtttcatcttcaacgtcgccggtgcgccagaagaggtgaaacagtttagtgggatttcccgtccagagtcgtggggccgctggtccaacgcgcagctgggcgatgaagtaaaaatcgagtacaagcatccgctgccgaagaaatttgacctggtgattaccgccaaagcatacggcaataacgccagccgtcctattccggtacgcgtaggcaatgaagaacaaactcttgtgctgggcaatgaagtgaccaccaccacactgcatttcgataacccaaccgatgccgacacactggtaattgtgccgccggaacctgtctcaaccaacgaagggaatatcctcggacactcgccgcgtaagctcgggatcggcatggtggaaattaaagttgtggaacgtgaagggtaatttctgactgatgtgtaggtcgcataaggtgcgacctacacatcttctccggcctacaaaacatcattgagaaacagaaaaaaaacagcgcccaacacttccccggacgctgcatggcaactttaataatctcgccttatcagaaagtaattacacccttaatcaactcacgattgttaatcacatcgcgctcgtaggtttctgccagcgtggcgaacggatagcgatgggttaacatcatgtcggcagtgatttttccttccgccatcagtcgaccgactttagcaaaatcttccggcgtggcgttgcggctgcccatcatcgtcgtttcttttttatggaattccggatcggagaactgcaactcacctttaaacaggccgacaaataccaccgtgccgccgtgacgaatcaaattcacggtgttattcatcgcatgttgattacctgtcgcgtcgatcactttctgcgccagcgaaccaccaaactgcgcccgtagctgcgcgtcaaaatcttcggctgacgggtccagtaaaggtaattccagacgcgttgccacatgttcacggcgcgccggactggtatccgccaccaccacctgtgcgccatcggctttagcgattgccgccgcgcccaaaccgattggccccgccccgaccaccagcacctgctcgccgggagcaatggctgcgcgacgcaccgcatgagcgctaatagcgaaaggttcaatcaatgcggccgcctgcgggtcaataccgtctgcgggcaaaatgttcgccaccggcacgctcaaatactcactaaaaccgccatcctgatgcacgccaatgactgaaattttttcacagcaattggtacgcccgcttttacacgccgggcattgctgacaggcaacataagggatcacagcaacttgctgaccatttttaagatcagcaatatttttacccagcccaacaatctccccacatatttcatggcctaaaacacgtggataactaaaaaatggttgatttccaccccaggcatgaatatcggtaccgcaaatcccgacagacttaatttttattaatgcttcattgtcacccggaataggtatctcgcgttgtttccagactaattctttcggctgctggcaaattaaaacattcatcgtagacatgattcggctctccattttttgttgccttagatatcaatgaaaatgaaaaatggcagcggaacggaaaatctgttttgtgaaaacacacgcataaaaatgttttaaatcgggttttaatggactcacaaggaggaaaatatgagtcgttcacaaaatttacgccacaatgtgattaaccaggtcattgatgatatggcgcggggtcatatcccttccccacttccatcgcaaagtgcgctggcggaaatgtacaacatcagccgcactacagtgcgtcatattctcagccacttacgcgaatgcggcgtcttaacgcaggttggaaacgactatgtgattgcgcgtaaacctgaccatgatgacggtttcgcctgtactaccgcttcaatgagtgaacaaaacaaagtgtttgagcaggcttttttcacgatgataaaccagcgccagttacgccctggggaaactttttctgaactgcaactggctcgggccgcgggtgtcagcccggttgtagtaagagaatatcttttaaaattcggccgttataatcttattcaaagcgaaaagcgcggccagtggagcatgaagcaattcgatcaatcctacgccgagcagctgtttgaactacgcgaaatgctcgaaacacattcacttcagcactttctcaacctgcctgatcatgatccccgctggctgcaggcgaaaaccatgctcgaacgtcatcggctactgcgtgacaacatcggcaatagctttcgcatgttctcgcaacttgacagagattttcactccttactgctttcagctgccgacaatatcttttttgatcaatctcttgagatcatctcagtcatctttcattttcactatcaatgggacgaaagcgatcttaaacagcgcaatatcattgccgtcgatgagcatatgaccattctcagcgctctgatttgccgcagtgaccttgatgccacccttgcgctccgtaaccatttgaattcagctaaacaatcaatgattcgatccattaatgagaacacgcgttatgctcattaagtacggattaaaaacagcaaactattagcgggtgcacggttttatcaaaagataaataccgggaaattcccgcttacctatgctcacaatcagtcgactaaaaatgtttttgtgagcggtagtaaagtcctaaaactttaacctgccgttaatgtcaaccttgcgtaatgcacaattacgtaaacaattaaaattataaatacaggagtccggcgtggaaaaagaaaatatcaccctcgatccgcgttcttcatttactccatcttcgtcggcagatattcccgtgccaccagatggattagttcaacgcagtacccgaattaaacgcattcaaaccaccgccatgttgttattattttttgcggcggtaatcaattatctcgaccgcagttcgctgtcggtagcaaatttaacgattcgtgaagaattgggattaagtgccaccgaaatcggcgctttgctctccgtgttttcactcgcttacgggattgcgcaacttccttgcggcccactattggatcgtaaaggcccacgcctgatgctgggactggggatgttcttctggtcactgttccaggccatgtctggcatggtgcacagctttacgcagttcgtgttggtgcgtatcggtatggggattggtgaagcgccgatgaacccatgtggcgtaaaagtcattaacgactggttcaacatcaaagagcgcggacgcccgatgggcttcttcaacgcagcttctaccattggcgttgccgtaagcccaccgattctggcggcgatgatgctggtgatgggctggcatgggatgtttattaccattggtgtgctggggatttttctcgccattggctggtatatgctctatcgcaaccgcgagcacgtagaactgactgccgttgaacaagcttatctcaatgcaggtagcgtcaatgcccgccgagatccgctcagttttgccgaatggcgcagcctgttccgtaaccgcacaatgtggggaatgatgctcggattcagtggcatcaactacactgcgtggctgtatctggcctagcttcctggttacctgcaaacagcctataacctggatttaaaaagcacagggttgatggcggctatccctttcctgtttggggctgccgggatgctggtcaacggttacgttactgactggctggtcaaagggggaatggctccgattaaaagccgtaagatctgcattattgccgggatgttctgttctgccgcctttacgctggtcgtaccgcaagcgacaacatccatgacggcggttctgctgattggcatggcactgttctgtattcactttgccggaacatcctgctggggcttgatccacgtcgcagttgcttctcgcatgacggcgtcggtgggcagtatccagaactttgccagcttcatctgcgcctcttttgcgccgatcattactggttttattgttgataccacccactcattccgtctggcactaatcatctgcggttgcgtcaccgcagcgggagcactggcgtacatcttcctggttcgtcagccgatcaacgacccgcgtaaagattaaactccctatgcccgataacattttgcttatcgggcatttttatggcgattaaaacgtttcccagttctccccgctatctgccactgccattttacgcggcgtagctggcgtcacgttttttaccacagccgatgtttcacgctgctgttgctgctgttgctgaatccggaacactgccactgcttcggtcaggcgactggcctgctcttccagcgcggcggcggcggcggcagattcttccaccagcgcggcgttctgttgagttacccggtccatctcagcaaccgctaagccaacctgatcgataccacggctctgctcatcagaagcagaagcaatttcgcccataatgtccgtcacgcgggtcacagcactgacaatctccgccattgtttccccggcgctttcgaccagcgtagagccaacatccactttccccaccgagtcttcaatcaggcttttaatttcacgagccgcctgggcgctacgctgggccagattacgcacttctcccgcaaccaccgcaaaaccacgtccttgctcacccgcacgcgctgcttcaaccgccgcgttcaaagccagaatattggtctggaaggcaatgccgtcaattacgctgataatatcggcgattttctgcgaactggtggagatatcacgcatagtctgcaccacgttatctaccactttgccgccgcgttgcgccgtttcagaagcacttaacgccaggtggctggcctggcgcgcattctcggcgttctgtttcaccgttgcggtcagttgctccatgctggctgccgtctcttccagcgaagcagcctgttgctcggtgcgcgaagagagatcgttattgccggtagcgatttcgctggcaccgctatagatggcattggccccgttgcgcacatcaccgacggtacgcatcagctctccctgcatatggcgcaaactctctgccagttgccccatctcattagagccatccacctcaatcggtttcaccagatcgccgcctgcaatatgacgaatgctgtcaatcaggcgattcattggcgctaccagcgaggctttaataccgaaccagacggcgaagatgaccgccagtacgacgatcatcacgcccaccagaatccacatcgcctggctgtaggaggcattgttatcgctgacggcgatatcatggagccgatcgttttgttccatgtaagccacatactgcttctcgaaaccgtcctgatatccctgggttggctgatcaaagaactcgttgattttgcctgcacctaacagttggatcagctccgccagcgcattgtgataaatatcgtaattacgtttgatctctgccgctgcggcggtgctctgacgcgggtcacgcggcaacgcttcgtaatccgcccagtttttttccgcctgtttcagcgaaatactggcactctgcatcagctcagcaacggttgaaccgctaccaatattattctgatccatcatgtagcggatacccgcgcggttgagggtgttacgcgtctgcaacaacgcgacccagctgccattcagcgtggattgctgctggcgaatggtttgtaaaacagtgaaattttctttgtcattctttaaggcattaaagaacagaccgcctgatgtcagttgtaaaaggccaaaaacggccaaaaccagcagtaagctggtcacaattttgatacgttttaacatggtttctctttcctgtggaccgatgcaagattttcggcctggaaaggaaaaactttatgaaaaggtgtaacccgccatccatggaaaaaccaggcgctggttatcagatattaaaaagttattcattatcgcccgggatgtcttcttgtcgggaattacccagagcaataaattcctctaacagatgggttaactgttgcattttctcggcagtaaactgagcttcaatctgccgataggcctcttcaatctgtgtctgagcgcggttatacagcgcctgcccctctttggtcagcgagatatagagcttccgctgatcattgatcggctttaatcgcaacactaaaccgtcgcgttccatccgcgtgaggatcccggtcaggcttgggcgcaaaatgcaggcgcgatacgccagatcgtgaaaatccattgatgggctttccgccagaatacgcacgatgcgccactgttgctcagtcaaattatgccgtttaacgattgggcgaaaataactcatcgccgcttctcgcgcctggagcaacgcaatggttagtgagtcgtgcattatctttcccctgaaaaattcaaaatcattaatatagaaacagttaatcatcacgttaccgggactgagctatccccgcaattcctcattttatcaaaattgagcatactttattaacttactgatatttagtattttattacctgcaaatgtaaatagtttgttaattagatcacatttacatcacttacttttgccaaactacgcaatcgggaataaaagtaatcattaacatattaatgattaagatgatcgaatccgaggagtggtaatgaaaggcactatcttcgccgtagcgttgaaccatcgcagccaacttgatgcatggcaggaagcgttccagcaatccccctacaaagccccgcctaaaactgcggtctggtttattaaaccgcgcaatacggtgattggttgcggtgaaccgattccctttccacagggtgaaaaagtactgagcggtgcgactgttgcgctgattgtggggaaaacggcgacgaaagtacgtgaagaagatgcggcagagtacatcgccggatatgcgctggctaacgacgtcagcctgccggaagagagcttttaccgcccggcaatcaaagcaaaatgtcgtgatggattctgccccattggcgaaaccgtggctctcagcaatgtcgataatctgactatctataccgagatcaacgggcgtcctgccgatcattggaacaccgccgatttacaacgtaacgccgcgcagttgctgagcgctctgagcgaatttgccacgctgaatccaggcgatgccattctgctcggcacgccacaggcgcgcgtggaaatacagccaggcgatcgcgtgcgtgttctcgcagaaggtttcccgccgctggaaaatccggtagtggacgaacgtgaagtgaccacgcgcaagagcttcccaacgcagccacacccgcacggcacgctgtttgccctcggcctgaactacgccgaccacgccagcgaactggaatttaagccaccggaagaaccgctggtgttcctgaaagcgccgaataccctcactggcgataaccagacctccgtgcgcccgaacaatattgaatatatgcactacgaagcggagctggtggtggtgattggcaagcaggcgcgtaacgtcagcgaagccgatgctatggattatgtcgcgggctacaccgtgtgtaacgactacgccattcgcgactatctggaaaactactaccgccctaacctgcgggtaaaaagccgcgacggactgacgccgatgctttcaaccatcgtgccgaaagaggcgatcccggacccgcataatctgacccttcgcaccttcgtcaacggcgaactgcgccagcaaggcaccaccgccgatctgatcttcagcgtgcccttcctgatcgcctacttaagcgaatttatgaccctgaatccgggcgacatgatcgccaccggcacaccaaaaggcttatctgacgtggtgcctggcgatgaagttgtggtggaagtagaaggcgtgggccgcctggtgaaccgaattgtgagtgaggatacagcgaaatgaaaaaaataaaccattggatcaacggcaaaaatgttgcaggtaacgactacttccagaccaccaatccggcaacgggtgaagtgctggcggatgtggcctctggcggtgaagcggagatcaatcaggcggtagcggcagcgaaagaggcgttcccgaaatgggccaatctgccgatgaaagagcgtgcgcgtctgatgcgccgtctgggcgatctgatcgaccagaacgtgcctgagatcgccgcgatggaaaccgcggacacgggcctgccgatccatcagaccaaaaatgtgttgatcccacgcgcttctcacaactttgaatttttcgcggaagtctgccagcagatgaacggcaaaacctatccggttgatgacaagatgctcaactacacgctggtgcagccggtgggcgtttgtgcgctggtatcgccgtggaacgtgccgtttatgaccgccacctggaaggtcgcgccgtgtctggcgctgggcaataccgcggtgctgaagatgtcggaactctccccgctgaccgccgaccgcctgggtgagctggcgctggaagccggtattccggcgggcgtgctgaacgtggtacagggctacggcgcaaccgcaggcgatgcgctggttcgtcatcatgacgtacgtgccgtgtcgttcaccggcggtacggccaccgggcgcaacatcatgaaaaacgccgggctgaaaaaatactccatggaactgggcggtaaatcgccggtgctgatttttgaagatgccgatattgaacgcgcgctggacgccgccctgttcaccatcttctcgatcaacggcgaacgctgcaccgccggttcgcgcatctttattcagcaaagcatctacccggaattcgtaaaacgttttgccgaacgcgccaaccgtctgcgcgtgggcgatccgaacgatccaaatacccaggttggggcgcttatcagccagcagcactgggaaaaagtctctggctatatccgtctcggcattgaagaaggcgcaaccctgctggcgggcggcccggataaaccgtctgacctgcctgcacatctgaaaggcggcaacttcctgcgcccaacggtgctggcagacgtagataaccgtatgcgcgtcgcccaggaagagattttcgggccggtcgcctgcctgctgccgtttaaagacgaagccgaaggtctgcgcctggcaaacgacgtggagtacggcctcgcgtcatacatctggacacaggatgtcagcaaagtgttacgcctggcgcgtggcattgaagcaggcatggtgttcgtcaacacccagaacgtgcgtgacctgcgccagccatttggcggcgtaaaagcctccggcaccgggcgtgaaggcggtgagtacagcttcgaagtgttcgcggaaatgaagaacgtctgcatttccatgggcgaccatccaattccgaaatggggagtctgatatgggtaagttagcgttagccgccaagatcacgcacgtaccgtcgatgtatctctctgaactgccagggaaaaaccacggttgccgccagggcgcgatcgacgggcataaagagatcagcaagcgttgccgggaaatgggcgtcgataccattatcgttttcgatacccactggctggtcaacagtgcttatcacatcaactgtgcagaccattttgaaggcgtctacaccagtaacgagctgccgcattttattcgtgacatgacctacaactacgagggcaacccggagttggggcagcttattgccgatgaagccttaaagctcggcgtgcgggcaaaagcgcacaatattcccagcctgaaactggaatacggcacgctggtgccgatgcgctacatgaatgaagacaagcacttcaaagtggtctccatctccgcattctgtaccgttcatgattttgccgacagccgcaagctgggcgaagcgattctgaaagcgatcgaacagtacgacggcaccgtggcggtccttgccagcggttcgttatcgcaccgctttattgacgatcagcgtgcggaagaagggatgaacagctacacccgcgagttcgaccgccagatggacgagcgcgtggtgaagttgtggcgcgaaggccagttcaaagagttctgcaatatgctgccggagtacgccgactactgctacggcgaaggcaatatgcacgacacggtgatgctgctggggatgctcggctgggataaatacgacggcaaggtggagtttattaccgagctgttcccaagctctggcactggtcaggttaacgctgttttcccgcttcccgcgtaaggaaaaaccatgccgcactttatcgtggaatgtactgaaaatattcgtcaagaagcccgcttacctgagctgtttgccagtgttaacaccgcactggcggcgacggggatttttccgcttgggggaatacgtagccgggcacactggatcgatacctggcaaatggctgatggcaagcacgattacgcctttgtgcatatgacgctaaaaatcggcagcgggcgcagtctggaaagccgtcaggaagtaggcgaaatgctgtttgatctgattaaaacgcacttcgcctcactgatggagagccgttacctggcgctttcatttgagattgcagagctgcacccgacgttgaatttcaaacagaacaacgtacacgcgttgtttaaataaatttgcaccagcttccaggctggatgataaggcgcagccgcatccggcaatgccacaggatatcgctatgttcgataaacacacccacaccctgatcgcccagcgtctggatcaggcagaaaaacagcgtgaacagatccgcgcgatctcgctggattacccggagatcaccattgaagacgcctacgccgtacagcgcgaatgggtccgactgaaaatcgccgaaggccgcacgctgaaaggccacaaaatcggcctgacctcgaaagcgatgcaggccagctcacaaatcagcgagccagattacggtgcattgctggacgacatgttcttccacgatggcagcgatatcccgaccgatcgctttatcgtgccgcgcattgaagtggagctggcttttgtgctggcaaaaccgctgcgtgggccaaactgcacgctgttcgacgtctacaacgccacggactacgtgatcccggcgctggagctgatcgacgcccgctgccacaacatcgatccggaaacccagcgcccgcgcaaagtgttcgacaccatttctgataacgccgccaacgccggagtgatcctcggcggtcgtccgatcaaaccagacgaactggatctgcgttggatctccgccctgatgtatcgcaatggcgtgattgaagaaactggcgtcgccgctggtgtgctaaatcatccggcaaacggcgtggcctggctggcgaacaaactcgcaccgtatgacgtacaactggaagccgggcaaatcattctcggcggttcgttcacccgcccggttccggcgcgtaagggcgataccttccacgtcgattacggcaacatgggctccattagctgccgctttgtttaaggagagaacgatggaaaacagttttaaagcggcgctgaaagcaggccgcccgcagatcggattatggctggggctaagtagcagctacagcgcagagttactggccggagcaggattcgactggttattgatcgacggtgagcacgcgccgaataacgtgcaaaccgtgctcacccagctacaggcgattgcgccctaccccagccagccggtggtacgtccgtcgtggaacgatccggtgcaaatcaaacaactgctggatgtcggcacacaaaccttactggtgccgatggttcaaaacgctgacgaagcccgtgaagcggtacgcgccacccgttatccccccgccggtattcgcggtgtgggcagtgcgctggcccgagcctcgcgctggaatcgtattcctgattacctgcaaaaagccaacgatcaaatgtgcgtgctggtgcagatcgaaacgcgtgaggcaatgaagaacttaccgcagattctggacgtggaaggggtcgacggcgtgtttatcggcccggcggatctgagcgccgatatgggttatgccggtaatcctcagcacccggaagtacaggccgcgattgagcaggcgatcgtgcagatccgcgaagcgggcaaagcgccggggatcctgatcgccaatgagcaactggcaaaacgctatctggaactgggcgcgctgtttgtcgccgtcggcgttgacaccaccctgctcgcccgcgccgccgaagcgctggcagcacggtttggtgcgcaggctacagcgattaagcccgacgtgtattaatgccggatgcgctgcgcttatccggcctacactcgcaccaaaccgtaggccggataaggcgtttacgccgcatccggcaaaaagccgtaccaaatcgcggaccggataaggcgtttgtgcgcatccgccataaaccttgtcgtaccctacaaaaatcccattagaggaagaaaaatgagcgacacctcacctgccataccggagagtatcgatccggcgaatcagcataaagcgctgactgccggacaacaggcggttattaagaagctgtttcgccgcctgatcgtctttctgttcgtgctgtttatcttctcgttccttgatcgcatcaacatcggctttgccggactcacgatgggacgcgacctcggtctgagcgccaccatgtttggcctcgccaccaccctgttctacgccgcttatgtcatcttcggcattcccagcaacattatgctgagtattgtcggtgcgcggcgctggatcgccaccatcatggtgctttggggcatcgcctctactgccaccatgtttgccactggccccaccagcttgtacgtactgcgtatactggttggcattaccgaagccggctttctgcctggcattctgctgtatttaaccttctggtttccggcctatttccgcgcccgtgccaacgccttgtttatggtggcaatgccggtaacgacagcgttgggatcgatcgtttccggctacattttgtcgctggatggcgtaatggcattaaaaggctggcagtggctgtttttgctggaaggcttcccgtcggtattactcggcatcatggtgtggttctggcttgatgactcaccggacaaagctaagtggctgacgaaagaagacaaaaaatgcctgcaagagatgatggataacgatcgtctgacgctggttcagccagagggagccatcagccaccacgccatgcaacaacgcagcatgtggcgggagatcttcactccggtggtgatgatgtataccctggcgtatttctgcctgaccaacacacttagtgcgatcagcatctggacaccgcagatcctgcaaagctttaatcagggcagcagtaatatcaccatcggcctgctggccgccgtaccgcagatttgtaccattctcgggatgatttactggagccgtcactcagatcaccgccaggaacgaaggcatcacaccgcccttccttatttgttcgctgccgctggttggttactggcttcggcaactgatcacaacatgatccagatgctggggatcattatggcttcgaccggatcattcagcgcaatggcgattttctggacaacaccggatcagtccatcagcctgcgggcacgagcgatcggtattgcggtgatcaacgccactggcaacattggttcagcattaagtccgtttatgatcggctggttgaaagatctgaccggcagctttaacagtggattgtggtttgttgccgcgctgctggtgattggtgcggggattatctgggcgattccaatgcagtcctcccgtccgcgagcgaccccgtaaggaacgacgatgcgtgaccgtcagattgccaatattgatatcagcaaagagtacgatgaaagcctgggtacggacgatgtgcattatcagtcgttcgcccgcatggcggcattttttggccgccatatgctgccacatcgccacgaacagtactttcagatgcatttcctcaatagcggacagattgagctacagcttgacgatcatcgctactcggtggaagcgcccctgtttgtcctgacgccgccgtcagtacctcatgcgtttattacggagtctgacgccgacggtcatgtgttgacggtacgggaagatctgatctggcccctgctggaagttctgtatccgggcactcgggaaaccttcggcctgccggggatttgcctgtcactggcagataaacccgacgaactggcggcgctggaacactattggcaactgatagagcgggaatcggtggaacaactgcctggacgggaacacaccctgacgctcctggcacaggcagtgttcaccctactgctgcgtaacgcaaaactcgacgaccatgccgccagcgggatgcgcggagaattaaaactgttccagcgttttcatatgctgattgaaagccattttcatcagcactggacagtaccggattacgctaacgaactgcatatcaccgaatcacgactcacggacatctgccgtcgctttgccaaccgtccgccaaaacggttgattttcgacaggcagctgcgagaagccaagcggctgctgctgttttctgataacgccgtgaacaatattgcctggcaactcggttttaaggatccggcttattttgcgcgctttttttatcgcttagtcggttgctcgcccagtgcttatcgtgccaaaaaagtacctgtgacgtgaaaatcccttagccttaacgggaaaccaggcaccacctgctattcccctttctccgcctggagcaaggggatttagtaacgtcaaaaatcgctaaaagcgacctcgatcacaaaaccgtacccgacctgaaaagtaccagccattgtcccaaaagtctcttcccgtaatcgcccctgcaagcttcaattgaataacaaaaacaacacacaaaattaacaatcgtattccgattaatactgtagaggtcgacatgaaaccagaagatttccgcgccagtacccaacgtccgttcaccggggaagagtatctgaaaagcctgcaggatggtcgcgagatctatatctatggcgagcgagtgaaagacgtcactactcatccggcatttcgtaatgcggcagcgtctgttgcccaactgtacgacgcgctgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagctgctttcggttgcgcactgggcgcgaatccgggcttttacggtcagttcgagcagaacgcccgtaactggtatacccgtattcaggaaactggcctctactttaaccacgcgattgttaacccaccgatcgatcgtcatttgccgaccgataaagtgaaagacgtttacatcaagctggaaaaagagactgacgccgggattatcgttagcggtgcgaaagtggttgccaccaactcggcgctgactcactacaacatggttggcttcggctcggcacaagtaatgggcgaaaacccggacttcgcgctgatgttcgttgcgccaatggatgctgatggcgtgaaattaatctcccgcgcctcttatgagatggtcgcgggtgctaccggctcaccgtatgactacccgctctccagccgcttcgatgagaatgatgcgattctggtgatggataacgtgctgatcccatgggaaaacgtgctgatctaccgcgattttgatcgctgccgtcgctggacgatggaaggcggttttgcccgtatgtatccgctgcaagcctgtgtgcgcctggcagtgaaactcgacttcattacggcactgctgaaaaaatcactcgaatgtaccggcaccctggagttccgtggtgtgcaggccgatctcggtgaagtggtggcgtggcgcaacaccttctgggcattgagtgactcgatgtgttctgaagcgacgccgtgggtcaacggggcttatttaccggatcatgccgcactgcaaacctatcgcgtactggcaccaatggcctacgcgaagatcaaaaacattatcgaacgcaacgttaccagtggcctgatctacctcccttccagtgcccgtgacctgaacaatccgcagatcgaccagtatctggcgaagtatgtgcgcggttcgaatggtatggatcacgtccagcgcatcaagatcctcaaactgatgtgggacgccattggcagcgagtttggtggtcgccacgaactgtatgaaatcaactactccggtagccaggatgagattcgcctgcagtgtctgcgccaggcacaaagctccggcaatatggacaagatgatggcgatggttgatcgctgcctgtcggaatacgaccagaacggctggactgtgccgcacctgcacaacaacgacgatatcaacatgctggataagctgctgaaataacgcagcaggaggttaagatgcaattagatgaacaacgcctgcgctttcgtgacgcgatggccagcctgtcggcagcggtaaatattatcaccaccgagggcgacaccggacaatgcgggattacggcaacggctgtctgctcggtcacggatacaccaccgtcgctgatggtgtgcattaacgccaacagtgcgatgaacccggtttttcagggcaacggcaagttgtgcgtcaacgtcctcaaccatgagcaggaactgatggcacgccacttcgcgggcatgacaggcatggcgatggaagagcgttttagcctctcatgctggcaaaaaggtccgctggcgcagccggtgctaaaaggttcgctggccagtcttgaaggtgagatccgcgatgtgcaggcaattggcacacatctggtgtatctggtggagattaaaaacatcatcctcagtgcagaaggtcacggacttatctactttaaacgccgtttccatccggtgatgctggaaatggaagctgcgatttaagctccagccccttcacgcattcgtcgaaggggcatttttattgtgatctcaatcacatatccacccgatgaataattcttgcccaaccgctcaccgccattcctgaccgcttacatccctaaaataaccactcagttatttaccttactttacgcgcgcgtatctctggcaacatcactgcaggatagcggtcaatttacctcctcaaacgcaacgcaaacctagaacggcttcggcctatgattaacaaattactctatggattttggtttgcaggaaggcagcaagtgagtgaatccccgggagcttacaacagtaagtgtcagaggtgaacgaacgcagctgccgcacctgtaagccaaaagacgacgagtaaaatgccaggttttactatggatacgaaaaaactattcaagcacataccctgggtgattctcggaatcatcggtgcattctgcctcgcggtagttgcattacgtcggggggagcacgtcagcgccctgtggatcgtggtcgcctctgtgtcggtgtatctggtggcgtatcgctactacagtttgtacatcgcccagaaggtgatgaaactcgaccccacgcgcgcgacgcctgcggttattaacaacgacggtctgaactacgttccgaccaaccgttacgtgttgtttggtcaccacttcgccgctatcgccggtgctggtccgctggttggtccggttctcgccgcgcagatgggctacctacctggcacgctgtggctgctggcgggggtagtactggccggtgcggtacaggactttatggtgctgtttatctcctctcgccgtaacggcgcatctctcggtgagatgatcaaagaagagatgggaccagtaccggggactatcgcgctgtttggctgtttcttaatcatgatcatcatccttgccgtcctggcgctgattgtggttaaagccctggccgaaagcccgtggggtgttttcaccgtttgctcaaccgtaccgattgcgctgtttatgggtatctacatgcgctttatccgtccggggcgtgtgggtgaagtctctgtcattggtatcgtgctgctggttgcctctatctacttcggtggcgtgattgctcacgatccgtactggggtccggcactgacctttaaagacaccaccattaccttcgcgctgattggctatgcgtttgtttccgcactgctgccggtgtggctgatcctcgcaccgcgcgactatctggcaaccttcctgaaaatcggcgttatcgtcggcctggcgctgggtatcgtggtgctgaacccggaactgaaaatgcctgcgatgacccagtacattgacggtactggcccgctgtggaaaggcgctctgttcccgttcctgttcatcaccatcgcctgtggtgcggtatctggcttccacgcgctgatctcttccggtacgacgccgaaactgctggctaatgaaaccgacgcgcgtttcattggctacggcgcaatgctgatggagtccttcgtggcgattatggcgctggttgctgcgtccatcatcgaaccgggtctttacttcgcgatgaataccccgcctgctggccttggcatcaccatgcctaacctgcatgaaatgggtggcgagaacgcgccgatcatcatggcgcagctgaaagacgttaccgcacacgcggcggcaaccgtcagctcctggggcttcgtgatttcgccagagcagatcctgcaaaccgcgaaagacattggtgagccttctgtcctgaaccgtgcaggtggtgcgccgacgctggcggtaggtatcgctcatgtgttccacaaagtgctgccgatggctgacatgggcttctggtatcacttcggtattctgttcgaagccctgttcatcctgaccgcgctggatgcgggtacccgttctggccgctttatgctgcaagacctgctgggtaacttcatcccgttcctgaaaaaaaccgactctctggttgccggtatcatcggtactgcgggctgtgtgggtctgtggggctacctgctgtatcagggcgtggtcgatccgctgggcggcgttaagagcctgtggccgctgttcggtatctccaaccagatgctggcagccgtggcgctggtactgggcaccgttgtgctgattaagatgaagcgcacccaatacatctgggttaccgttgttccggctgtatggctgcttatctgcaccacctgggcactgggtctgaaactgttcagcaccaacccacagatggaaggcttcttctacatggcaagccagtacaaagagaagattgctaacggtactgacctgacggcgcagcagattgccaacatgaaccacattgttgtgaacaactacaccaacgcgggcctgagtattctgttcctgattgtggtgtacagcatcatcttctacggtttcaaaacctggctgaaggtgcgtaacagcgacaaacgtactgacaaagaaacaccgtacgttccaatcccggaaggcggcgtgaagatctcttcgcaccactaaccgtgtttagccccgcttcggcggggctttgttcttatcagagtgaactatgtttggtaacttaggacaggcaaaaaaatatctcggccaggcggcgaagatgttgattggcattccagactacgacaactacgtcgagcatatgaagaccaaccatcccgacaagccgtacatgagctatgaagaattcttccgcgaacgccagaacgcgcgctacggcggcgatggtaaaggcggtatgcgctgttgttaatggagagagcatgaacccgattgcagttaccctactcaccggttttttaggcgcgggcaaaaccaccctgctgcgccatattcttaacgaacaacacggctacaagattgccgtgattgaaaacgaattcggcgaagtctccgttgatgatcaactgattggtgaccgcgccacgcagatcaaaacgctgaccaacggctgcatctgctgttcgcgctccaacgagctggaggacgcgctactcgacctgctggataatctcgacaagggcaatattcagttcgaccgtctggtcattgaatgcaccggcatggccgatcccggcccgattattcagacctttttctcccatgagattttatgccagcgttacctgctggacggcgtgattgcgctggtggatgcggtacatgccgatgagcagatgaaccagttcaccatcgcccagtcacaggttggctacgccgaccgtattctgctgactaaaaccgacgtcgcaggcgaagcagaaaaactgcgcgaacgcctggcgcgcatcaacgcccgtgcaccggtctacaccgttacccacggcgacatcgacctgggcctgctgttcaacaccaacggttttatgctggaagagaacgtcgtcagcaccaaaccgcgtttccactttatcgcggataaacaaaacgatatttcgtcgattgtggtggaactggattacccggtagatatcagcgaagtttcccgcgtgatggaaaacctgctgctggaatcggcggataaactgctgcgttacaaagggatgctgtggattgacggcgaagctaaccgcctgctgttccagggcgtccagcgcctctacagcgccgactgggacagaccgtggggcgatgaaaaaccgcatagcacgatggtgtttatcgggattcagttgccggaggatgagattcgggcggcgtttgcggggttgaggaagtaaggggttatgggccggataaggcgcagccgcatccggcctgatatttcactcaaaatagtccatatccagtttcggcaccttcaacaaacgtgaagaaacccctacttcgttttcgatcattaagtgcaccaggcgttccccatcaaccaacaccataccctcgacggattgagcaaagtcacgcgcctgagacgtaaatccagaagtggtaataaacaccccacgtttcgccttttgcccagccagtgcgccgtaaaatgcctgtaattctggcctgcctacagtgttctgccaacgttttgcctgaacataaactttctccaggccaagtttatcaagcgatatcacaccatcgatgccaccatctccagtaccgccaacacgctgcaaatcatcacggtggccgccataccccaggcgatgcaaaacatccagaacaatgacttcaaagcgcgaaggagaaacctgcaataagttttccagaacctcatcagccaccgcatcacgaagctcttttagcgcctgatctaaccgatcgtccgggctgctctttgctagttcttcatgatcgggagagtcggctttcggatctaaatcgacggcatccggccgtgacttaagtttgacattcacaaaatcgaaggccagatggttcgtctcctgctccgtcattggctggggatgagacgcaacccagtcaaaacccgcaggagtcaggcaccatttgccacgcgacaaactttgcgacaacccggcacgttttaaacggtcatgtgcccagcctgcacgatttttataaacaagttgtccgctggtaatgactttcgctcgctggctgtcatccagtcctaatgcatccgcggcagcctcatgaacatcacgcgcggctgcaccttccggttttgtcgccagataacgcagaacaggttcaataaatttgtcataggtaggaaccgtcatagtacatccttgcagaatcaggtagatgtttttcggctactataacactaccaaaatagacgaacacgttagaaatgagtcagttgctgtgactccggtcattgtccggaaaggtacagaaagctaagataagacgttatgggccttaaatatttggacaggcccacacagcaatggattaataacaatgatgaataaatccaacttcgaattcctgaagggcgtcaacgacttcacttatgccatcgcctgtgcggcggaaaataactacccggatgatcccaacacgacgctaattaaaatgcgtatgtttggcgaagccacagcgaaacatcttggtctgttactcaacatccccccttgtgagaatcaacacgatctcctgcgcgaactcggcaaaatcgccttcgttgatgacaacattctctctgtatttcacaaattacgccgcattggtaaccaggcggtgcacgaatatcacaacgatctcgacgatgcccagatgtgcctgcgactcgggttccgcctggctgtctggtactaccgtctggtcactaaagattatgacttcccggtgccggtgtttgtgttaccagaacgtggcgagaacctctatcaccaggaagtgctgacgctaaaacaacagcttgaacagcaggtgcgagaaaaagcgcagactcaggcagaagtcgaagcgcaacagcagaagctggttgccctgaacggctatatcgctattctggaaggcaaacagcaggaaacagaagcgcaaacccaggctcgccttgcggcgctggaagcacagctcgccgagaagaacgcggaactggccaaacagactgaacaggaacgtaaggcttaccacaaagaaattaccgatcaggccatcaagcgcacactcaaccttagcgaagaagagagccgcttcctgattgatgcgcaactgcgtaaagcaggctggcaggccgatagcaaaaccctgcgcttctccaaaggcgcgcgcccggaacccggcgtcaataaagccattgccgaatggccgaccgggaaagatgaaacgggtaaacagggctttgcggattatgtgctgtttgtcggcctcaaacccatcgcggtggtagaggcgaaacgtaaaaatatcgacgttcccggcaagctcaatgagtcgtatcgctacagtaaatgcttcgataatggcttcctgcgggaaaccttgcttgagcactactcaccggatgaagtgcatgaagcggtgccggagtatgaaactagctggcaggactccagcggccaacaacggtttaaaatccccttctgctactccaccaacgggcgcgaataccgcgcagcaatgaagactaaaagtggcatctggtatcgcgacgtgcgtgatacccgcaatatgtcgaaagccttacccgagtggcatcgcccggaagagctgctggaaatgctcggcagcgaaccgcaaaaacagaatcagtggtttgccgataatcccggcatgagcgagctgggcctgcgttattatcaggaagatgccgtccgcgcggtggaaaaggcaatcgtcaagggtcaacaagagatcctgctggcgatggcgaccggtaccggtaaaacccgcaccgcaattgccatgatgttccgcctgatccagtcccagcgttttaaacgcattctcttccttgtggatcgccgttctcttggcgagcaggcgctgggggcgtttgaagatacgcgtattaacggcgacaccttcaacagcattttcgacattaaagggctgacggataaattcccggaagacagcaccaaaattcacgttgccaccgtacagtcgctggtgaaacgcaccctgcaatcagatgaaccgatgccggtggcccgttacgactgtatcgtcgtcgatgaagcgcatcgcggctatattctcgataaagagcagaccgaaggcgaactacagttccgcagccagctggattatgtctctgcctaccgtcgcattctcgatcacttcgatgcgataaaaatcgccctcaccgccaccccggcgttgcatacggtgcagattttcggcgagccggtttaccgttatacctaccgtaccgcggttatcgacggttttctgatcgaccaggatccaccaattcagatcaccacccgcaacgcacaggagggtgtttatctctccaaaggcgaacaggtagagcgcatcagcccgcagggggaagtaatcaacgacaccctggaagacgatcaggattttgaggtcgccgactttaaccgtggcctggtgatcccggcgtttaaccgcgccgtctgtaacgaactcaccaactaccttgacccgaccgggtcgcaaaaaacgctggtcttctgcgtcaccaatgcccatgccgatatggtggtggaagagttgcgtaccgcgttcaagaaaaagtatccgcaactggagcacgacgcgataatcaagatcaccggtgatgccgataaagacgcgcgcaaagtgcagaccatgatcacccgcttcaataaagagcggctgcccaatattgtggtaaccgtcgacctgctgacgaccggcgtcgatattccgtcgatctgtaacatcgtgttcctgcgtaaagtacgcagccgtattctgtacgagcagatgaaaggccgcgccacgcgcttgtgcccggacgtgaataaaaccagctttaagattttcgactgcgtcgatatatacagcacgctggagagcgtcgacaccatgcgtccggtggtggtgcgtcctaaggtggagctgcaaacgctggtcaacgaaattaccgattcagaaacctataaaatcaccgaagcggatggccgcagttttgccgagcacagccatgaacaactggtggcgaagctccagcgcatcatcggcctggccacgtttaaccgtgaccgcagcgaaacgatagataaacaggtgcgtcgtctggatgagctatgccaggacgcggcgggggtgggctttaacggcttcgcctcgcgcctgcgggaaaaagggccgcactggagcgccgaagtctttaacaaactgcctggctttatcgcccgtctggaaaagctgaaaacggacatcaacaacctgaatgatgcgccgatcttcctcgatatcgacgatgaagtggtgagtgtaaaatcgctgtacggtgattacgacacgccgcaggatttcctcgaagcctttgactcgctggtgcaacgttccccgaacgcgcaaccggcattgcaggcagttattaatcgcccgcgcgatctcacccgtaaagggctggtcgagctacaggagtggtttgaccgccagcactttgaggaatcttccctgcgcaaagcatggaaagagacgcgcaatgaagatatcgccgcccggctgattggtcatattcgccgcgctgcggtgggcgatgcgctgaaaccgtttgaggaacgtgtcgatcacgcgctgacgcgcattaagggcgaaaacgactggagcagcgagcaattaagctggctcgatcgtttagcgcaggcgctgaaagagaaagtggtgctcgacgacgatgtcttcaaaaccggcaacttccaccgtcgcggcgggaaggcgatgctgcaaagaacctttgacgataatctcgataccctgctgggcaaattcagcgattatatctgggacgagctggcctgacacgtatacacttcatccttcaggctgcctctgcgttggctgcgctcgttcaccccggtcacgtacttctgtacgctcccggggattcactcacttgccgccttgatgcaacctgaatgattttgtgtatattaccctcggcaatttcttcttctgcggctcgatgaatttgggccgctgcttaatttacggaactcacaatgaacaataacgatctggtcgcgaagctgtggaagctgtgcgacaacctgcgcgatggcggcgtttcctatcaaaactacgtcaatgaactcgcctcgctgctgtttttgaaaatgtgtaaagagaccggtcaggaagcggaatacctgccggaaggttaccgctgggatgacctgaaatcccgcatcggccaggagcagttgcagttctaccgaaaaatgctcgtgcatttaggcgaagatgacaaaaagctggtacaggcagtttttcataatgttagtaccaccatcaccgagccgaaacaaataaccgcactggtcagcaatatggattcgctggactggtacaacggcgcgcacggtaagtcgcgcgatgacttcggcgatatgtacgaagggctgttgcagaagaacgcgaatgaaaccaagtctggtgcaggccagtacttcaccccgcgtccgctgattaaaaccattattcatctgctgaaaccgcagccgcgtgaagtggtgcaggacccggcggcaggtacggcgggctttttgattgaagccgaccgctatgttaagtcgcaaaccaatgatctggacgaccttgatggcgacacgcaggatttccagatccaccgcgcgtttatcggcctcgaactggtgcccggcacccgtcgtctggcactgatgaactgcctgctgcacgatattgaaggcaacctcgaccacggcggcgcaatccgtctgggcaacaccctgggcagcgacggtgaaaacctgccgaaggcgcatattgtcgccactaacccgccgtttggcagcgccgcaggcaccaacattacccgcacctttgttcacccgaccagcaacaaacagctgtgctttatgcagcatattatcgaaacgctgcatcccggcggtcgtgcggcggtggtggtgccagataacgtgttgtttgaaggcggcaaaggcaccgacatccgtcgtgacctgatggataagtgtcatctgcacaccattctgcgtctgccgaccggtattttttacgcgcagggcgtgaagaccaacgtgctgttctttaccaaaggcacagtggcgaacccgcatcaggataagaactgcaccgacgacgtgtgggtgtatgacctgcgtaccaatatgccgagtttcggcaagcgcacaccgtttaccgacgagcatttgcagccgtttgagcgcgtgtatggcgaagacccgcacggtttaagcccgcgcactgaaggtgaatggagttttaacgccgaagagacggaagttgccgacagcgaagagaacaaaaacaccgaccagcatcttgctaccagccgctggcgcaagttcagccgtgagtggatccgcaccgcaaaatccgattcgctggatatctcctggctgaaagataaagacagtattgatgccgacagcctgccggagccggatgtattagcggcagaagcgatgggcgaactggtacaggcgctgtctgaactggatgcgctgatgcgtgaactgggggcgagcgatgaggccgatttgcagcgtcagttgctggaagaagcgtttggtggggtgaaggaatgagtgcggggaaattgccggaggggtgggttatcgccccagtatctacggtcacaactctaatccgaggagtaacgtataaaaaagagcaggcaataaattatctaaaagatgattatttgcctcttatccgtgcgaacaatattcagaatggcaagtttgatactacggacttggtttttgttcctaaaaatcttgttaaagaaaatcaaaaaatatctcctgaagatattgttattgcaatgtcatcagggagcaaatccgtagttggtaaatccgcacatcagcatctaccatttgaatgtagtttcggcgcattttgcggtgtattacgtcctgaaaaacttatattttctggttttattgctcatttcacaaaatcttctctttatcgaaacaaaatttcatcactttctgctggtgcaaatattaataatattaagccggcaagctttgatttgataaatataccaatcccaccacttgccgaacaaaaaatcatcgctgaaaaactcgatacgctgctggcgcaggtagacagcaccaaagcacgttttgagcaaatcccacaaatcctgaaacgttttcgtcaagcggtattggggggcgcagttaatggaaaattgacagaaaaatggcgtaattttgagccgcaacattctgtatttaagaagttaaattttgaatctatcttaactgaattacgtaatggtctttcatcaaagccaaatgaaagtggtgttggtcatccaatactacgcattagttctgtacgtgctggccatgtagatcaaaacgatattcggtttctagaatgttcagaaagtgaactaaaccgccacaaattacaagatggagatcttttatttactcgctataacggaagtttagaatttgttggtgtttgtgggttattgaaaaaattacaacatcaaaatttgctatatcctgataaacttattcgagctcgattaaccaaagatgctttaccagaatatatcgaaatatttttttcatccccctcagcacgaaatgcaatgatgaactgcgtgaaaacaacttctggtcaaaaaggtatttcaggaaaagatatcaaatcccaagttgttttattacctccagtaaaagaacaagccgaaatcgttcgccgcgtcgagcaactcttcgcctacgccgacaccatagaaaaacaggtcaacaacgccttagcccgcgtcaacaacctgacgcaatccatcctggcaaaagcgttccgtggtgaacttaccgcccagtggcgggccgaaaacccggatttgatcagcggagaaaacagcgccgccgcgttgctggaaaaaatcaaagctgaacgcgcagctagcgggggtaaaaaagcctcacgtaaaaaatcctgaacattattttctggcgcacctttccggtgcgctttttattatttcacgccaatcataacccacataaatatatttaaatcattccagaaattgcccattttattctatttttagctggactttccccatatttactgatgatatatacaggtatttagcgcggtgcggatgtgcgccaacacacccgcatcgctaatcacaatcactattcctggagaatagcagttatgactgacacgcattctattgcacaaccgttcgaagcagaagtctccccggcaaataaccgtcatgtcaccgtcggttatgcgagtcgctacccggattacagccgtattcccgccatcaccctgaaaggtcagtggctggaagccgccggttttgccactggcacggcggtagatgtcaaagtgatggaaggctgtattgtcctcaccgcccaaccacccgccgccgaggagagcgaactgatgcagtcgctacgccaggtgtgcaaactgtcggcgcgtaaacaaaagcaggtgcaggcgtttattggagtgattgccggtaaacagaaagtcgcgtaacagcgtttactcccggttaaccaccgggagccttccactgactcaatagaaactttccccctcagtaaatatttaccagtctgattttgcagtaaaaatctattgtttcagtacgttgcgaaagcgataatagaggcttagcaatgaggaaggcatatcttatggaatctattcaaccctggattgaaaaatttattaagcaagcacagcaacaacgttcgcaatccactaaagattatccaacgtcttaccgtaacctgcgagtaaaattgagtttcggttatggtaattttacgtctattccctggtttgcatttcttggagaaggtcaggaagcttctaacggtatatatcccgttattctctattataaagattttgatgagttggttttggcttatggtataagcgacacgaatgaaccacatgcccaatggcagttctcttcagacatacctaaaacaatcgcagagtattttcaggcaacttcgggtgtatatcctaaaaaatacggacagtcctattacgcctgttcccaaaaagtctcacagggtattgattacacccgatttgcctctatgctggacaacataatcaacgactataaattaatatttaattctggcaagagtgttattccacctatgtcaaaaactgaatcatactgtctggaagatgcgttaaatgatttgtttatccctgaaaccacaatagagacgatactcaaacgattaaccatcaaaaaaaatattatcctccaggggccgcccggcgttggaaaaacctttgttgcacgccgtctggcttacttgctgacaggagaaaaggctccgcaacgcgtcaatatggttcagttccatcaatcctatagctatgaggattttatacagggctatcgtccgaatggcgtcggcttccgacgtaaagacggcatattttacaatttttgtcagcaagctaaagagcagccagagaaaaagtatatttttattatagatgaaatcaatcgtgccaatctcagtaaagtatttggcgaagtgatgatgttaatggaacatgataaacgaggtgaaaactggtctgttcccctaacctactccgaaaacgatgaagaacgattctatgtcccggagaatgtttatatcatcggtttaatgaatactgccgatcgctctctggccgttgttgactatgccctacgcagacgattttctttcatagatattgagccaggttttgatacaccacagttccggaattttttactgaataaaaaagcagaaccttcatttgttgagtctttatgccaaaaaatgaacgagttgaaccaggaaatcagcaaagaggccactatccttgggaaaggattccgcattgggcatagttacttctgctgtgggttggaagatggcacctctccggatacgcaatggcttaatgaaattgtgatgacggatatcgcccctttactcgaagaatatttctttgatgacccctataaacaacagaaatggaccaacaaattattaggggactcatagtggaacagcccgtgatacctgtccgtaatatctattacatgcttacctatgcatggggttatttacaggaaattaagcaggcaaaccttgaagccatacccggtaacaatcttcttgatatcctggggtatgtattaaataaaggggttttacagctttcacgccgagggcttgagcttgattacaatcctaataccgagatcattcctggcatcaaagggcgaatagagtttgctaaaacaatacgcggcttccatcttaatcatgggaaaaccgtcagtacttttgatatgcttaatgaagacacgctggctaaccgaattataaaaagcacattagccatattaattaagcatgaaaagttaaattcaactatcagagatgaagctcgttcactttatagaaaattaccgggcattagcactcttcatttaactccgcagcatttcagctatctgaatggcggaaaaaatacgcgttattataaattcgttatcagtgtctgcaaattcatcgtcaataattctattccaggtcaaaacaaaggacactaccgtttctatgattttgaaagaaacgaaaaagagatgtcattactttatcaaaagtttctttatgaattttgccgtcgtgaattaacgtctgcaaacacaacccgctcttatttaaaatgggatgcatcgagtatatcggatcagtcacttaatttgttacctcgaatggaaactgacatcaccattcgctcatcagaaaaaatacttatcgttgacgccaaatactataagagcattttttcacgacgaatgggaacagaaaaatttcattcgcaaaatctttatcaactgatgaattacttatggtcgttaaagcctgaaaatggcgaaaacatagggggattattaatatatccccacgtagataccgcagtgaaacatcgttataaaattaatggcttcgatattggcttgtgtaccgtcaatttaggtcaggaatggccgtgtatacatcaagaattactcgacattttcgatgaatatctcaaataagcggtaagttttatagaaaataccgctcccgacaccacatcgggagcggctcatcatcaggaggcgatcacctccaccagcacatccgttgcccaactctcttcgctgttggcgacattcccttccttgcaggcctgagccattttgactaactggaaagaaacgtcatcgcggaaatcaaagtaatgccattgcgatgaaaagttgatgcgccagtagcccatcccctgatcgaagcggatcttcaatacctgaccatcctcaaaagtcaccgtcagtttacgatggtgagggatatcgcgcggcgagtcgaacaccgtcagttctaccggcctgcccagcgcagcagcaaaccactgatcagcgaaatcctgaaaatccgctatgctcatccagtcatggaaaggccggttaccggggcgatctttatctttaaatagcgtatccagcgtcacttcagcgccatcggtcagctttgtttttagcggtctcagaattgatcccaacaacgccagcgcaaccgggttttgcagatagcgatcggtatagtgaacgccggtaattcgcgtgttattcatcagtgactgcgcttcttcatggtcgttaaacagcacgtcccagaagcgttgcccaaactgcgacagtggtccattcaactgtttgtggatctgaatgtctttgacccgctcgacagcgttggtggctttagccggcagaataaactcgttcagttctaccgttttataaccgagactacgcaccaccagttcgtcattcaggtgccactccggccccggaatcgttgcctgctggctgcgagaggccagcgtcatcacgcgatcggtaaaggtgacctgggcaacgatcggtaattgcagatcctgttcaacatggcacagccgcacacccagcgcagtaaattgcgatagttcatgcaacaggtccgggtcatccactcccgtaggaataacaagatcgacctcgacgttgtcttttagccgatagttctgaaccgccgcgcggaactgacgtgcgtataaatcccactcattgggcgcgccggtcatccacagggtgagcttttcagcgccttcgttaatcgcccggcgaatcgtatcgccaatggcgccagggcagtagcgggcatccggcagcgagaatgtctcttcatccggtaaaccgatgtaatacgtgaagtcatcgccaagccaggccagcgccgctttgcgatccagcaaatcgtgatcgtggcgagtctgggaatcaagcaggcattcactacatgcagtctcacaatggcggcagcctaactgtttcaccattccctgcaatatagcttcaatgtgtaccggtgcgctggaggcaaaacctgcaccaccgctgatcacatcataaagctgtacggctaataccgattgcccatcctccagtctgaccggacgtacagaatagccgagttctgcggcggagatacccagaacgcccgccagcgcctgacgcagagcaaccgccagagtcatggcaacaatccgcccctcctctgtgttatctggcagatactcgccgttttgcggtttgcgcagaaccatttcaaagacatcggtacgcgccagtgcgcccagggtgacattcttcatgagtgccgtcgaaccggggcaaatcagacgatgattctggctgtcgcgatccgctttacccggacgcggtggatagtgagcttccatacttttcggcgcatcattttcattcagcatcgactcagcacggccacagctcagacacaatgcataaccgtgtccaccttcccccaaactttgctggaaaacatgcccatcagccccagaagccatataacccattagcgggttaggcaacggtacgggctctgctttaacaaagacccacgcggggacaaccgggacgaatttcatggtttcaatattgttcgttaccggagcgtgtgcatcggtgacaaacccggcaggctgcagcacctgacggcgattatccatgattattttttcgccgcaggcgctattggagcaaaagagcatcccggaactgctcatcccctcttcatagccaatggtcccgcatttgtgacagcgccaggcgcaatccagacgctgggcttcattggtatcagcattaatgttgtgccagtgcagtgagacaccggcagagcggaagacacggccatcaaggatgatctctgctcccggtgcatattcacgaatggcaacaccgaggttacgggaaggtaatcctttataacgggaaacgttatcttcacggtcctttttatcacgacttttctgcgatttttcgcggatataatcttccatcgtgaagttatcaaacgtcactacatctgtcgggaaaccgtatcccggcaggaaggttctggcagccagatcgcgcagcagatactcgccacagtgccgtttcttctccagctctatgcgcttacgataaggcgtttgcggctgcgactcacgctcctgtgtcacgagatcgcgataaacggagagccaccgctgttgcaggaaggtgatcgcgttgattgttttatcccgcagatattcggctcttgcaccatgcaacgccgtacctttcaccagccgttccagcgccgtgtcgatatcaagaaccggacgttccagccagattttaaagcgttcgcattttgactgcccgtcatcttcaccgaaaaaccagaggctatcgaggctggttttttctttatcggtttcgccaataacgttacataaaaagtcggacagtaataatgcattgacgtgacgttgcaccagtcgggcggagttcatcgcgaccatgggtgccgggatcatggtttcaaatggccagagcgggttggcaaaaacctgctggtcgtgtgggttacctttacatagggtgtaagagatcgcgcgtgattctttactacgcccggctcgcccggcgcgctgtaaatagttggccggatgtggcggtacgttgttcattaccaccgcagtaatacccccgatatcaacccccatttccatggtggtggaacagttgagaacatttagttgcccattcttgaacatcttttcatagctttgcagacgttctgacgactgctgggcagagtgctcggcagtacgatagtagaagccgccttccacgacacgatcgttaatgtctgtccagacgttttccgaccgcaattgtgcgatcagcggatcatggctgacccagtcgcgtgcttttgccagaccctctgcgtagtcttcctgtgaacgatccagcttccagatttccggcattgtgactttctgcgcgacaaaagtgtcatattgcgccagggtaagatgctcgaacgaaatatgggtaggcagataaggggttaagcctttaaaagccgtatccaggattttattggttaccgggcaaatccaggcatccgtgattaaagaaaaagtcatatgctctttcggtaaataaaaacggttgccatcgggtttcagtactgcaagcggtccggtaagttgggcccatgcttctttcagccatgtattgataatatcaatagttgccgcattgacggttttgaatccagcccccagcatcagcaacttcgctaaacgatgggatacgttgccattacgaatttgaggccagcgtctgttctgattatcttcaggatcttttgattccgggttacggacgaattttgatgaaaaacggctaccaatccagtttttcagctcatcatccagctgtgtgaagttgctctcgcgaacgtaatgatccaacgtaaccttgagaaaatcgcgccagtcatccagcgttaatcctttttcctgccagtgcaaggggctcttatgtattttctccagcccctggtaaccaacctgaaccagcccctgtgtttccaggctgttagtccgtttagggcgacgcatgaattcccggaacaacaacatttcagaaagcttaagggggccgccgttttcattaaacacttcaggcttaagataatggttatattgcagaaccggcccgcggatatcggctctctctttaagctcgttaaccatctccgtccaggttcgggataccaggatagtcgcagctttcccaccggttgcagcctgataagcctgttcaagctgttcagcctgtgcttgtgacaatttcgcctggtctggcattccccagcttcgatattcttctgcctgctcacgggcttgcttcgccctggccgctaatttttccagatcggcattggcattcggcgctgtagacgtttgcgtcctttgatgccagctgagaatttcgactacgcttccgcgtaagcgactgcgttctgcttcttgctgcatacgcaccgccattcgggctgtcccttgtcgactgtctgtaaaggtgatgagtcgacgacctcgtcctggcaacgaatctggtccgacgccctctttgccttcatcactggtaaagtcctgacaatactctagaacggtgggcacgatattagtaacgtaaaatggcccacctaatagtgcacgccggaagggctgtttcccactcatgcctctgtagccacagccactggcactacaaacctgttcaatatcattaataatcagcggaatgctgtcattgttaataacgccaatacggcgcgtctgacggtcgaggcgttgtagggtataacctgcctcgctggtctctcctgcggcaataatcaacggaggctgaaaactgttctctttttcgactttttcttctgtagcgtcatgttcaacaggtacttcatcctgcaaagagaattcatcgccacctttattttcccactggactagtttgccctttttgtcccgtgccagaagatgaggctcattacaatcattacagaatgcaacttcgtatacagggcttccacagtcacaattttgtcgctggttcacatacacatagccaaagggccagcctttgtcgagcggtgtaccgtgctttaatctgcaatctttatcaacacaagcccatattccctgggtattacgctggaagatatgcgccctgactttaagaaatgcgggatcctttgcattaggttgagtccctgaacagacatcgatccaacgcagtacttcctgctggctgtaatgctgttttgtcagcacgtgtaaccgctctgttatctcatccagcttcatcggattgggctgtttgaccaacatctcacgtatgtaacgcgcttcgggggaatgcgtaagcgcataaaagcgctcaggacttatccctttaattttattatcatttttatctcttagatccagatcaggtatttgctctatctcgtctaacggaacagaaacgtttttggatggttccagttcaggaatcacccgacttccgtccagaacatcgatgcgctcctgcgggataccggataattcagagagaaattttttcagctgcttttcagcgtcgctgccggcaatggtcgcagaggtcgcgacaaagcgcacgtcatctggtgtcacgccaaacgcggtcatcacacgacgcagctggagcgccagttcagcggcctgcgaccctacataggtatgcgcttcatccagtacaatccagcgtagtgatttttgtgctttagattgctggataatcggggcgtcgacctggcgaaccatcatatattccagcatcgtgccgttggtcaccagaatcggcgcaggttcttcacgcattttttcgcgcgagagcacctcattcggcctttttgcctgttcgctttttaccgaagcgtgtaggttttcggtgttgccgttgtaaaggcagtagcggatccctgtaccaaaaccacgcgtccaggcatccagacgctcgcgctgtgaattaatcagggcgttcaatggatagagaaaaagggctcggacaccgaccaacggattgttgccattttcatgcagttcccggtaaagatcttccagcaccggtaccataaaacattccgttttacctgaacccgtaccactggttaccaccactgaatgtttcttttccagcaaagctttccaactggctaactggtgcgtaaaaggcctccagtcagcaccaaaccggtaccggccattattctgatcatccagtgaatcaaccactgctttgctcaacaatgcgttgccttccgtcaggctgcgcatcgtgtggtttgactccttccagccaaacatttgctggaataccggagaagcaaggaatgagcccggtttcccacaatcagcccccatttgttgcgcgagatgttcacgcagctgcgggttggtaacgcccatgatactgagcgttgcttcagttgaacgagacaacgattgttcaataagtgacgaaaaatagcgtgtagtcatccttattcctttttattttttagcaacataacgcaacaggctgcactggaagatggccttaaaccagcgggaatcgaaatccctgacttgcctcaggaaaaatacggcaccgggtttacggtcaaatacagattcaaaagaagcatttccgcttgccacagctgcagcgaagacgggtaacaaggccacggaatagcggtgatttgcgtcaggattaataccaatcactggatttttttgtgatgccatccagctatgcagccgcttgctgccgtactctggccattgagcttcactatgctcacgtaaaagctcctgataccacacgtggacaaaagactcaggaatagacggggggagatgtccgttacttaaccatttctcaatttcatcggcatatgtcgggaacacgagccccagccgttgaaacatattagtaaccagtaatttctgggtttcctccggtgcacctttttggctcaggaacaatttgaaacgctcagatgccgctttgatctcaaagatggggaaaaactcccatagaatagggaactcattctcaatacgactcaggtactctgctgacatttcaaatttgaagagcgacattgccaatgcctgcggatgctgcaccagtgcacgccatacttcaaaggttgccagtggtaaataaccaaattgatcgtacaggctacgcataaattgccagccggaatgggcaggatcgttagccatctgtccgagaaccagtgtgatggtattaacttctgcctgtggattaaaaagctgggtcgctttctgcaatgagcggatgttgctttcttctaccggtaacgaagattcgccacgaatgaagcagggacgaaaagccatctcttcacccggtttagggacaaccaaccacggtccatttttgttaacgattgagctcaactcatattcaccgacaggcactccctcgctcattcttgatgctaaggggatggatttcctctcgggttcacttaacagcatgataacgggggaaggaatctgtccagcacgatggttcactgactggctgagtaatagttctttttcataatcatagcgcagactgtatttatagcgacgaatttgccaggccatgaccacacccgcccccgtaatacgcatctcaacaacctggtcaatacctgcctcaagtgaaatcaggttctcaatatgttcgcgcagactatagagattcaattcaacaggacgatcgctcaacgccgtataacaccattcgtgccatgcctgtaatccactaacggagcgcaaatgcaactgcaatgtatatcttgtcggctcgccatttctggagaacagaaacgctctggaacccagcagatcatgcagcgtaatgtttttatccagaggacgtccgtttacatcaagagcgagacagcctttagcgggaaaaggtaactcaatatcgatggggtcagccgccaaattaggcagaacttgtaatgtaataaatgccggaggtaccccttccgctttgagttgtatctctgttcgcccctcagtacgcttacgtgtagcctccaatgttttatctttaagttttgctacacaaggatgctgtgtggtgattacgatagtgccttcatttgcgtgtattccaccttttatctcaatactgaaatcagcaggcaaaataccgattttgcgacgcaagagcgtttcattcttactattacggatagaaagatattgagcccccagcatctcttgtatatgacattgctcaattgaaattccgctcaggtaacgcgttacatcaatgctttgaatatccggtagtgtagaaatgacttttggtacaccaataaatgtttcatctggatgacaaacccagcttgcacgctttccatttagagcaaaccttccgatgctgatttgttctcttccggtgcgaatccgataagtttcatttgctgtaactgtaacgtcctgacatcccttcacaggtagtgcttttagtcctaatacgtttactgccctcgattggccatcaaaaccagcaacattgctattatcccgagggagcacaatcagaacatcgctgcttcgcacactgcaagaagcctgtccctgtaacagccattgatctgcatcaacgatgaaggttaacggcacctcaccaatggcaatttcactgtcatcaagtttaatgctcccaacaatcatccctccagcacgagccactaacgacaaacctgccgatggattttgcctgccaaatctcacttcgcttttacgtaatcgaactgttgcctgtctgttttccagagaagcataggctggcccaaggccagagacttcctcaccatcttcacaaatggcaagttcaaagcgcgtagttgacggctcgcttgttacaggaaaggaaacttcgtccggaagagatactatcaccctaagctcatctggatgcttttctgaccaatagaattggcaacgcgtactcttatttttttgtagtcgaggcttagcctctacagaggctgcgcatagcagtccattcaaaaaatgcgttcctgtttcatcatctaacggtattggaaactcgcttcgccaggtagggtgaaccttctcaagctgttgtactggttctttgtgatttattaggttgtgagtaagtactaaggaattgaggttatcagccatatgactgataagttctacagaggtatcttcgctaaaaacagttggcagcgctgatttttctatgacagctcttgccagcgaaagggcagaaaaacctgactgctttgcttgctcatattgtccaaggatcctggagaaaacagccagaaagcgactgtctgattctttgagtagccggaaaggtaaaccaccttcactgaataatgttccgagaaaattgcgtcgttcagattcataaaatcgaattgggcgcagccagtaatcttccatccctttcggtacgatagtaccaagctctgtggcggtgaatgaaatccctatttttttatatatagggtcccacgtccatccgcattgccgttcataatccctgcggtaccactcagagcaaaaaagaacaaaacaggcagcaaagtccctattacatatattagattgtgattgaccgactgcacggagtagctgcgttaattgggtatattcatcattggttgcatgatattcataaagaggacggccatccggttgtctcaaccctctaagattcacaaagttacttagccaggaagtacattttacccatgaaatgtattctgattgacccaaagcaagctccttagagataaaagatacaaaaacaaaaccccacaacatttctaatttgaaagaaaacctttcagaatattgtatagttactcaggcggcaacaactattttttcaggtcgatactataaatcaattttagataaaaatgatatcaaccatctattaatcacaactcatttatcacctgattttataatttcaaatgaaaataaatctcaaacaatcaaaaagtattcagtagctgacatttaactttccagggtataaaacaattagggaaggtgcgaataagcggggaaattcttctcggctgactcagtcatttcatttcgctggccgctgtatgaatcccgcctgaagggaaagctgcacgtaatcagcaagcgttacactcagcgaattgagcggcataacctgaatctgagacaacatctggcaaggctgggacggaagtcactgtcgttctcaaaatcggtggagctgcatgacaaggtcatcgggcattatctgaacataaaacactatcagtaagttggagtcattacctaccatttacaaaaatctgcattaattaatagatgtgataaatatttaatatgcttaagtatttgttgtatttatattgcaatagttaatttgttttaaatcaataaaacaatgtgtttacattgcggcaacttttttgatgtgagaaatttgtttccaagagacacagactcttaacaaccaaaaataaattttattaaggaacatattatgaaacgttcaattattgctgccgctgtcttttcttctttttttatgagcgctggggtatttgccgcagacgttgataccggaacattaaccattaaagggaatattgcagaatctccgtgtaaattcgaagcgggtggcgattcagtaagtattaatatgccaactgtaccaaccactgtctttgaaggtaaagctaaatactcgacctatgatgatgcagtcggtgtaaccagcagcatgttaaaaattagctgtccgaaagaagttgctggtgtaaaactctcgttgattaccaacgataaaataaccggaaacgataaggcgatagccagtagcaacgataccgtggggtactatctctatttaggtgataacagcgatgtcctggatgtttctgcaccttttaacattgagagttataaaacagcggaaggtcaatatgctattccgtttaaagcaaaatacctgaagctgacagataattcagtgcaatcaggtgatgtgttatcttctctggttatgcgtgtggcgcaggattaataaataaaatttcaagtttctccagttaataaacatggccgctatccccatggcggccttttaatttaagaggcattaagatgaaaggattattagctttactcatttcttctatggtccttcctgcacatgccggtattgttatctacgggacgcgtattatttacccggcagagcacaaagaagtgatggtgcagttgatgaaccagggaaaccgttcttcgctgctgcaggcgtggattgatgatggtgatacgtcgttaccaccagaaaaaattcaggttcctttcatgttaacgccaccagtggcaaaaataggggaaaattccgggcagcaagtaaaaatcaaaattatgccgaataaactgcccactaataaagagagcattttttatctgaatgttctggatattccaccaaatagtccagagcaagagggcaagaatgcactgaaatttgcaatgcaaaacagaatcaaattgttttaccggcctgcgggtattgcaccggtaaataaagcgacatttaaaaagttactggtaaatcgcagtggcaatggattggtgataaaaaatgactcagcaaattgggtaacgatttcggatgtcaaagctaataatgtcaaagtcaattatgaaactattatgattgcccccttagaaagtcagagtattaatgtcaaaagtaataatgcgaataactggtatctgaccattatcgatgaccatggcaactatattagtgacaaaatttaattgcaggagctgcctatgttgagaatgaccccacttgcatcagcaatcgtagcgttattgctcggcattgaagcttatgcagctgaagaaacctttgatacccattttatgataggtggaatgaaagaccagcaggttgcaaatattcgtcttgatgataatcaacccttgccggggcagtatgacatcgatatttatgtcaataagcaatggcgcgggaaatatgagatcattgttaaagacaacccgcaagaaacatgtttatcaagggaaattatcaagcggttaggcattaataccgataactttgccagcggtaagcaatgtttaacatttgagcaacttgttcagggtgggagctatacctgggatatcggagtttttcgtctcgatttcagtgtcccgcaggcgtgggtggaagaactggaaagtggctatgttccaccggaaaactgggagcgaggtattaatgcgttttatacctcttattatgtgagtcagtattacagcgactataaagcgtcgggtaatagcaagagtacatatgtacgttttaacagcgggttaaacttactggggtggcaactgcattctgatgccagtttcagtaaaacaaatagcaatccaggggtgtggaaaagcaataccctgtatctggaacgtggatttgcccaacttctcggcacgcttcgcgtgggtgatatgtacacatcaagcgatatttttgattctgttcgcttcagcggtgtgcggttgtttcgtgatatgcagatgttgcctaactcgaaacagaattttactccacgggtgcaggggattgctcagagtaacgcgctggtaactattgaacagaacggttttgtggtttatcagaaagaggttcctcctggcccgtttgcgattacagatttgcagttggccggtggtggagcagatcttgatgtcagcgtgaaagaggcggacggttcggtaaccacctatctggtgccttatgcagcggtgccgaatatgctgcaacctggcgtgtcgaaatatgattttgcggcgggtcgtagccatattgaaggggcgagcaaacaaagtgattttgtccaggcgggttatcagtatggttttaataacttattgacgctgtatggcggatcgatggtcgcgaataattattacgcgttcactttggggactagctggaatacacgcattggtgccatttccgtcgatgccacgaagtcgcatagtaaacaagacaacggcgatgtgtttgacgggcaaagttatcaaattgcctacaacaaatttgtgagccaaacgtcgacgcgttttggtctggcggcctggcgttattcgtcgcgtgattaccggacatttaacgatcacgtttgggcaaacaataaagataattatcgccgtgatgaaaacgatatctatgacattgccgattattaccagaacgattttggccgtaaaaatagcttttctgccaatatgagccagtcattgccagaaggctggggttctgtgtccttaagtacgttatggcgagattactgggggcgtagcggcagcagtaaggattatcagttgagttattccaacaacctgcgacggataagctataccctcgcggcaagccaggcttatgacgagaatcatcatgaagagaaacgttttaatatttttatatcgattccctttgattggggtgatgacgttacgacgcctcgtcggcaaatatatatgtctaactcaacgacgtttgatgatcagggttttgcctcaaataatacgggattatcgggaaccgttggaaaccgggatcaatttaactatggggtcaacctgagtcatcagcatcagggaaatgaaacaacagctggagcgaatttaacctggaacgcgccggtggcaacggtgaatggcagttatagtcagtcgagtacttatcgacaggctggagccagtgtttcagggggcattgtcgcctggtcgggtggcgttaatctggcgaaccgtctttccgaaacgtttgcagtgatgaatgcgccaggaattaaagatgcttatgtcaatgggcaaaaatatcgcacaacaaaccgtaatggagtggtggtatacgacggaatgacaccttatcgggaaaatcacctgatgctggatgtgtcgcaaagcgatagcgaagcagaattgcgcggtaaccggaaaattgccgcaccttatcgcggcgcggttgtactggttaattttgataccgatcagcgcaagccctggtttataaaagcgttaagaacggatgggcaaccattaacgtttggttatgaagtcaatgatatccatggtcataatattggcgttgtcggccagggaagccagttatttattcgcaccaatgaagttccgccatcggttaatgtagcaattgataagcaacaaggactttcatgcacaatcaccttcggtaaagagattgatgaaagtagaaattatatttgccagtaatagtcaggtggttctatgaaaattcgcataatgctatttatattaatgatgatggttatgccagtgagctatgcagcatgttatagtgagttatctgttcagcacaatttggttgttcagggggattttgcacttagtcaaacacaaatagcgacatatgagcataattttaatgattcgtcatgcgtgagtacaaatactatcacccctatgagcccgtcggatattattgttggactttataacgataccattaaattaaatttacattttgaatggaccaataaaaacaacatcacgttgtcaaataatcagaccagtttcaccagtggttattcggtaacggtgacacctgcggccagtaatgcaaaagtgaatgtttctgcggggggcggcggttcagtaatgattaatggtgttgcaacattatccagtgcttcatcatcgacacgcgggagtgctgcagtacaatttttactgtgtttattcggtggcaagtcatgggatgcatgtgtaaatagctacagaaatgcattggcacaaaatgcaggtgtctattcctttaatctgacattgtcatacaacccgataaccacaacctgcaaaccggacgatttattaattactttagagagtattcccgtttcacaattaccagccaaaggtaacaaagcaacaataaatagtaacaaaggggatattgttctgcgttgtaaaaacttattaggtcaacaaaatcaaacatcacggaaaatgcaggtgtatttatcaagttctgacttgtggggcagtagtaacacgatcctgaaaggtgcggaagataatggcgtaggatttattcttgaaagtaatggttcgccagtcacacttttaaatatcactaacagcagtaaaggatatacaaatttaaaggaagttgctgcgaagtcaaaacttacagatacaacgatttcaattccgataactgccagttactacgtctacgatacaaacaaagttaaatctggcgcactggaggcaaccgcattaatcaacgtgaaatacgactaataacaagcaagacgagcaagtggctaataataaaaataataaggtgtctgcatttccccctctcttcgagggggctttttttcagcgatgataaaaaatctcaccgtcgtaggctttaatgattttaccgtcggtgtcgttgatcaacacgtacgcgccacccatataggtccagtgtgtcccggcatcaggcgcgggcaggttacgtaactgccactgcttaatgttgtactcatcggtgcggtacatctctgggacggtatcgcctggtttgaaatgcttaaagtcagcaatgaaactgcttaactcatacttagaaattcccgaggtattggtcgaacccgcggtggctggtgcggcccaggcggcactggtaaccagcaaaagcacacccagcaacatcttatttttaatggtcataaactctccactttggggatctgtaatatcagtcgcatatctttcctgccatacaatataactgacaagcgatattttgttagtgatcccatgatttcgtaaaaagtgtaaatgaaaggatgccctaaaagcatccttagcgagcagagagtcagcggaaatagctgatttaagaatcatcctgggctgaagataacatgcaagcctaaaggattgagttatcgcattatgcccatgaagccatgtacgcccatatacacaccaactaagccaatcaacagactggaaaaatagggggcgcgtttagcgagagtgttaaatccgctccagcgttttgcgacctgctgaacgctgattgctgcgccaacgcctacggtgacaagcgttaacgccaggccaatgctgaaactgacgaccagtgttgcgcccagtgtcagggctttcaactgaatgcatatcaacagcacggtaattgctgccgggcaggggataaggccaccggttaagccaaatagcaaaatttgccagttggtgacctctctaccatcaaagcgtcgtttaatgtcattggcatgggctcgtgcatgggcatcctgatactcgccatgttcgtgatggtgatgatgtccatggtcgtggtgatcttcgtgatcgtggtgatgatgctcatgatcatgctcgtgcatattctccagccagttgcgttcgccgcgccaggtacgccagaacatccagaacgcggtgccaataatgatcactgcggaaatcaactggagccacggttctgctgattgagcagtaaagcgcttgctgatcaccatcccgccaaaggcaatcaaccagaccaccgcggtatgcgaaatggttgctgccagtccgagcatcaccgcctgtttaatggtgtctttgatggcgatgataaacgccgccatcatcgtttttgagtgccctggttccaggccatgaagcgcaccaagtaagatggcgctggggatgaagaaccaggcgtttccttgctgaagaagagtggtaaattcggtcatgataataattcttagtattaattcggcaatcttattctactcccccccagtacctgatactaccccccagtagattaatagtgctatgatttttcatattcttgttaaccaggtgttgccatgtctcataccatccgtgataaacagaaactgaaagcgcgtgccagtaagattcagggccaggtcgtggcgctcaagaaaatgctcgacgagccgcacgaatgcgctgcagttttacaacagattgctgctatccgtggcgcggtaaacggtctgatgcgggaagtgattaaaggtcatctgacggaacacatcgttcaccagggggatgagctaaaacgtgaagaagatctggatgtcgttctgaaggtgctggattcttatatcaaataatttattaacgcgattgtaaaactgcggtttttactcgtttacaacgcgtgcgctggacattaccatcctcctctgcgatttatcatcgcaatcaaacgactcggggtgcccttctgcgtgaaggctgagaaatacccgtatcacctgatctggataatgccagcgtagggaagtcacggaccaccaggtcattgcttcttcacgttatggcaggagcaaactatgcaagtcgacctgctgagttccgcgcaatctgcgcacgcgttacacctttttcaccaacattcccctcttgtgcattgcatgaccaatgatgtggtgcaaacttttactgccaataccttactggcgctcggtgcatcgccagcgatggttatcgaaaccgaagaagccagtcagtttgcggctatcgccagtgcgttgctgattaacgttggcacactgacgcagccacgcgcacaggcgatgcgtgccgccgttgagcaagcaaaacgctctcaaacaccctggacgcttgatccggttgcggttggtgcactcgactatcgccgctgtttttgtctggaacttctgtctcataagccaacagccatacgtggtaatgcttcggaaatcatggcattagctggcattgctaatggcggacggggagtggataccactgacgccgcagctaatgcgatacccgctgcacaaacactggcacgggaaactggcgcaatcgtcgtggtcactggcgaggtggattatgttaccgatggacatcgtatcattggcattcacggtggcgatccgttaatgaccaaagtggtaggaactggctgtgcattatcggcggttgtcgctgcctgttgtgcgttacccggcgatatgctggaaaacgtcgcatctgcctgtcactggatgaaacaagccggagaacgcgcagtcgccagaagcgaggggccaggcagttttgttccacatttccttgatgcgctctggcaattgacgccggaggtgcaggcatgaaacgaattaacgctctgacgattgccggtactgatccgagtggtggtgcggggattcaggccgatcttaaaaccttctcggcgctaggtgcgtatggttgctcggtaatcaccgcgctggtggcgcaaaatacccgtggcgtacagtcggtttatcgcattgagcctgattttgtcgccgcccagctcgattcggtgttcagcgatgtgcgaatcgataccactaaaatcggtatgttggcggaaaccgatattgttgaagcggtggcagaacggctgcaacgttatcagatccaaaacgtggtactcgacaccgttatgctggcaaaaagcggcgacccgctgctttcaccttcggcagttgccacgctacgcagtcgattattgccacaggtttcattaataacgccaaacttgcccgaagcagccgccttgctcgacgcgccacacgcgcgcaccgaacaggaaatgctggaacaagggcgatcgctgttggcgatgggctgtggcgcagtgctaatgaaaggtggtcatctggatgatgagcaaagcccggactggctgtttacccgcgagggtgaacaacggtttaccgcacagcgcattatgaccaaaaacactcacggcactggttgtacgctctctgcggcgttggctgcactgcgcccgcgccatacaaactgggctgacaccgtacaggaggcaaaaagctggctttcatcggcattagcccaggccgacacgctggaagttggtcacggtattggtccggttcaccacttccacgcctggtggtgagcaccgtactatagccgctttggttattgtcagcctttggtgctgacattcagggatgaaaccaatgcagttgagaatcaccagtcgaaaaaaattcaccgctttattatgcgctcttgggctaatttccatcgttgcaatttatccgcgtcagacggtgaattttttctattcgacagcaattcagattaaagactacatccacttctacggttatcgcccggttaaatctttcgctattcgcattcctgccagttacaccattcacggaatagatgtttcgcgctggcaggagcggatcgactggcagcgggtggcaaaaatgcgcgataacggtattcgcttacaatttgcctttattaaggcgacggaaggcgaaaagctggtggacccctatttttcgcgtaactggcaactaagccgcgaaaatggcctgctgcgcggggcgtatcattatttttccccgtcggtatccgcttcagttcaggcgcgattatttctgcaaacggtggattttgcccacggcgatctccctgccgtgctggacgtagaagaacggggaaaattatcggcaaaagaattacgcaagcgggtaagtcagtggctaaaaatggtcgaaaaacgcacgggaaaaaagccgattatttactcaggagccgttttttatcactcgaatctggcgggctattttaatgaatatccgtggtgggtggctcactattatcaacgtcgtccggacaatgacggaatagcctggcgcttctggcagcattccgaccgtggacaggtagatggcattaatggtccggtggattttaatgtgtttaatggcacggtggaggagttgcaggcattcgttgatgggattaaagaaacgccttaaataagaagcagtgatatactcccaccagactccctggcaggaaaaagacaaatggaacaagcgcatacccagctgattgcacaactgaacgaacgtattttagcggcggataacacgccgctttatattaagtttgccgaaacggtaaaaaatgccgtgcgcagcggggtgctggagcatggcaatattttgcccggtgagcgtgatttaagtcagttaaccggcgtttcgcgcattacggtgcgcaaggcgatgcaggcgctggaagaagagggcgtggtgacgcgttcgcgtggttacggcacgcagatcaacaacatcttcgaatactcgttgaaagaagcgcgaggtttttctcagcaggtggtattgcgcgggaaaaagcccgatacactatgggttaacaagcgtgtcgtgaaatgtcccgaagaagtcgcgcagcagctggcggtcgaagcgggaagtgatgtctttttgcttaagcgtattcgctatgtcgatgaagaagcggtatcgattgaggaatcgtgggttccggcacatttaattcatgatgttgatgccatcgggatttctctttatgactacttccgcagccagcacatttacccacaacgtacgcgttcccgcgttagtgcccggatgccggatgccgagtttcagtcacatattcagttagatagcaaaataccggtgctggtgatcaagcaagtggcgcttgaccaacagcaacggcctattgagtacagcatcagccactgtcgcagcgatctatacgtttttgtgtgcgaggagtagttcctcgcgcgttggcgcacaatcaccgccccgatgcccgacaacccacgacgccactgcattgcccagtaatacagcatccgccagtggcagaccagaggccagcccggcaagtacgccacctgcatgactgtcgcccgccccaatggtgtctacaacttgcgttggatatgccggaatgcagccagaagcgtcgttgctgaaataccatgcgccttctttatcgagacgaacgatcaacggcgcggcaaatttctcctgccattgcttgccaagtgttgttatctctgcggataaagcaaaacgttcggcggcaatctcagcctcctgacgattgagtgacactaaaggtcgacaggccatgatccgcgccagtaatgcgtccgggatatcgccaatacgtgggccaaaatcgataaacggcgtcacgtcttgcagctcttccagccattccactaacaattcgccgcagggcgaggccagttgataaccggaaaaatagagcaggctgccaggcgcaacggttaatcgtgccaaccattggcgattccattgattttccacaccgctgaatgacataaaagtgcgttcgccatccggctcaaccagcgccagacaccagccgttatcgccttcggcgttatcgatcaggctgattaacccctctttcgccatccggttgcgaataatctccgcccacacgccctgaccgagcggcaaggcattacccgcttcgatgccgaggcgctttaacgccacggcaatattcagtgcgcagccgccaacgttaacgctctgctgtttcagttcgatatcgcacccacgccaggggagggcataagcgtcggcgatcacatcaatgaccgccgcgccgacgaccatcaccggctgacgcgtggctaattcaggcagcagcgtgtgtaatcgagcgccgctcatatcgcctcccgttgttggcgatacttcgccagcgccgtggcatagcggttgaaatcaagctgatttaccgcatccagttccgtctttaacgcaggatcgattgcgttaacgccatgcaatgcgccgcaaattgccgtcgccatagcaccgatggtgtctgtgtcgccgccaaggttagcgcacaggacggcgcaacggttcgggtcggtttgtgccagttcaaccagcgcaatggcgcacggaacggactcaatagtgctggtacctgcgccaacgacctggtaaagctgttcgctggcggattcgatgccgtcggcattgcgcacaattttcagcgcaatctccagacgtgctgccagtgaggcgctgaaggtagtgatgcgtttttgttgagcatgtcgcgcaattgaaggcagtgaatcaacaattgctgaccagctttctccgtcaatggcacgagaaatcgcccatgcgatgactaccgcccccgcaaccgccagatcggatttatgtgtcgggctggaggccagcgccacatcatcaataaaggaatcaacatcacgcgctggaagcaaacaacctaatggcgagacgcgcatcgctgcgccgttggtcacgccgttattttccagttcagcaacgggtttaccgtcgcgaatggcgttaagcgcaatcttcgaggtcggacctagtacgtttttgttaaaggcgtcgaaacgcagcgcccagtcgagaatattacgcccaatcagatctggatcgatcttgccttcacgttccagtaacgcatccgccagacacagcgccatcgaggtatcgtcggtgaattcggcgcggttaaaataacaggctgcgttattctcctttggtccaggcagaaaacgatcaatccagccaaagtgtgctttaacgcggctgcgtggccaaagctcggagggcatccccatcgcatcccctaacgcctgcccataaagagcaccgagaatacgttctgttttcatttaacttccccttgtgtcaacgcaatatcgcgatcatcgaccttgatagccgtaatttcgttgtcggattcgcggaaaaaaatcatgaacagcacggcgataatggcaatcatcaccgcgccaaaagtccacatcccggaccagttgaaagtcagtccgtttaccggttcctgataagcgaacatcttttccatcatcacaccgccaagacgatagccgagcaaactgccgaagccctggcagcagagcgtgatcagcccctgcgcggcggtacgcatatgcacgggggcttttttatcgacatagatgtaagcggtaacgtagtaaaaatcgtaacttacgccgtgaagcaaaataccgaggaacagtaacgcgtaggtgaaatattcatccgcactaccgtaaataaagaagccatagcggatcgcagcggtgaccagaccaagtaataatacctttttgataccaaagcgtttggtgaaaaacggcaatgccagcataaagaagatttcagagaactggccgagcgtcatccagccagtggcgtttttcataccgacttcggtcagataaccgttggcaaagatgtaatagaacgccagtggcatcgcaaacaggaatgaacagaagaaaaagacgaggaagtttttatcgcgcagcaggatcagcgcatccaggccgagcatgactttaatgtccattttgccggtgctttttggcggcgtgtcgggcaggaaaaacgcaaacacaccgagcagagcagaacttccggcagtaatcagcagcgggatgttagtcggagagatatcggcataacccagcatttgcggcaaaaatccacatgccagaccagaggcaatccagccgatagtgcccatcacacgaatgcgtgggaaatcacgctccacatccggcacgttggcaaaagcgatactgttagtcagcgcaatggtcggcatataggttagcgagtaggccagcagtaacgggaagaacccggcaaaagtggtctgttgcgcagcgaaatacatcagcgccgcaccagcgaacatcaataccgccagcactttctgcgccgagaaaaagcggtcagtgatggagccaaccagaattggcgacaggatcgccgcaatggcggtacaggcatacgaccagccaatttctccggcactaaaaccgcttttacttaaccacaaccacaatggcacaaaccacgcgccccagataaaccattcaacaaacatcatgaacgacagctttgctgttgttttcatcttttaattccttcatgacaggtaatgtaaggtacgcgatgacaataccatttaataataccttttaaatacctttgcggtgaaaacttgaccgcggtaacattttttctgatgaatcgagccaacagaaaacgctgataaaacatccaaaagatggaaaaactcgcctgtaacgaccaggattatgattgcccgcaaaaggcgggccaggacaatccatagccgatatccaatcggaatttacgggagcatagtaatgacagatattgcgcagttgcttggcaaagacgccgacaaccttttacagcaccgttgtatgactattccttctgaccagctttatctccccggacatgactacgtagaccgcgtgatgattgacaataatcgcccgccagcggtgttacgtaatatgcagacgttgtacaacaccgggcgtctggctggcacaggatatctttctattctgccggttgaccagggcgttgagcactctgccggagcttcatttgccgctaacccgctctactttgacccgaaaaacattgttgaactggcgatcgaagcgggctgtaactgtgtggcgtcaacttacggcgtgctggcatcggtatcgcggcgttacgcgcatcgcattccattcctcgtcaaacttaatcacaacgagacgctaagttacccgaatacctacgatcaaacgctgtatgccagcgtggagcaggccttcaacatgggcgcggtggcggttggtgcgactatctattttggttcggaagagtcacgtcgccagattgaagaaatttctgcggcttttgaacgtgcgcacgagctgggcatggtgacagtgctgtgggcctatttgcgtaactccgcctttaagaaagatggcgttgattaccatgtttccgccgacctgaccggtcaggcaaaccatctggcggcgaccataggtgcagatatcgttaaacaaaaaatggcggaaaataacggcggctataaagcgattaattacggttataccgacgatcgcgtgtacagcaagttgaccagcgaaaacccgattgatctggtgcgttatcagttagctaactgctatatgggccgcgcagggttgataaactccggcggtgctgcaggcggtgaaactgacctcagcgatgcagtgcgtactgcggttatcaacaaacgcgcaggcggaatggggctgattcttggacgtaaggcgttcaagaaatcgatggctgacggcgtgaaactgattaacgccgtgcaggacgtttatctcgatagcaaaattactattgcctgatacgccttatacgaacagcactaccacgtatgacggaaaaggcgtttacgtcgcatccggcataaaaacacgcgcactttgctacggcttccctatcgggaggccgtttttttgcctgtcattctgattaattttcgaattgtcgtttttgtgatcattatctcgacatttgaaaacaaatcatttcattatgttttgaaatcgaaagtaaacgacaggatatgaaaatgtacgtggtatcgacaaagcagatgctgaacaacgcacagcgcggcggttatgcggttccggcattcaatattcacaatctcgaaacgatgcaagtggtggtagaaaccgctgccaacctgcatgcaccggtcatcatcgccggaacgcctggcacatttactcatgctggtacagaaaatctgttggcgctggtcagcgcgatggcgaagcaatatcaccatccactggcaattcatctcgaccatcacacgaaatttgacgatatcgctcagaaggttcgttctggcgtgcgctcagtcatgattgacgcctcgcatttgccttttgcgcaaaatatttcacgggtcaaagaggtggtggatttttgccatcgctttgatgtcagcgtcgaagcggagctggggcaacttggcggccaggaagatgatgtgcaagtcaatgaagccgatgcgttgtacaccaaccctgttcaggcgcgtgaatttgccgaggcaaccgggattgattccctggcggtcgccatcggcacggctcatggtatgtatgccagcgcaccggtgcttgatttttctcgactggagaacattcgccagtgggtgaacttaccgctggtgctgcatggcgcgtcagggttatcgactaaggatattcagcaaaccatcaaactggggatatgcaaaatcaacgttgcaacggagctgaaaaatgccttctcgcaggcgttaaaaaattacctgaccgagcaccccgaagcgaccgatccccgggattatttgcagtcggctaaatccgcaatgcgcgatgtggtgagcaaagtgattgccgattgtggctgcgagggcagggcataacgcacctgccatttaacaaggaaaaaacatgaaaacgttaattgcccggcataaagctggtgaacatattggcatatgttcagtctgttctgcccatccgttggttatcgaagcggcgctggcatttgatcgcaacagcacgcgcaaagtgctgattgaagcaacgtcaaaccaggtcaatcaatttggcggttataccggcatgacaccggcggactttcgcgaatttgtttttgcgattgccgatagagttgggtttgcgcgcgaacgcattattctcggcggcgaccatctggggccaaactgctggcagcaagaaaatgcggatgcggcgatggaaaaatccgtcgagctggtaaaggcatatgttcgtgccggcttcagtaaaattcatcttgatgcgtcaatgtcctgcgcgggggatcccataccgttagcaccagaaacggttgcggaacgagctgctgtgctttgctttgctgcggaaagtgtggcgacagattgccagcgtgagcaactgagctatgtcattggcaccgaagtgccggttccgggcggtgaggccagcgccattcagtcagtacacatcacccatgttgaagatgccgccaatactttacgtacgcatcaaaaggcctttattgcccgtgggctggcagaggcgttaacacgcgtgattgccattgtggtgcagccaggcgtggaatttgatcacagcaatattatccattatcagccgcaggaagcacagccgctggcgcaatggatagaaaacacccgaatggtttatgaagcacattctaccgattaccagacccggacggcttattgggaattagtccgcgatcactttgcaatattgaaagtcggtcccgcattaacctttgctttacgtgaggcgatatttgcgttggcacaaattgagcaggaacttatcgcccccgaaaatcgcagcggttgcctggctgtaattgaagaagtgatgctcgacgaaccgcagtactggaagaaatattatcgcccgggttttaacgattcattactggatattcgttacagcctgtcggatcgtattcgttattactggccgcatagtcggattaaaaatagcgtcgaaacgatgatggtgaatctggaaggcatggaaatccctctgggcatgattagtcagtatcttcctaaacaatttgaacgcattcagtccggggaattatcagcaataccgcatcagttgattatggataaaatttatgatgttttgcgcgcctatcgctacggctgtgcggaataaggacggtatatgactaacctgtttgttcgtagcggaatttcttttgtcgatcgtagcgaagttttaacccatatcggtaatgagatgctcgcgaaaggtgtggttcatgatacctggccacaggcattaattgccagagaagcagaattccctaccgggataatgcttgagcagcacgccattgcaataccgcattgtgaggcgattcatgctaagtcgtcagccatttatctgttaaggccaacaaataaagttcattttcagcaagcggatgatgataatgacgtggcggtatcgttggttattgcgttgattgtggaaaatccgcagcagcaattgaaacttttacgctgtttatttggcaagttacaacagcccgagatcgtcgagacactaattactcttcctgaaactcagttaaaggaatacttcacaaagtatgttttagattcagacgaataaatccctctgtaacaataaaaaggactatttatgaaacgcaagattattgtcgcttgcggaggcgcggttgcgacctctacgatggcggcggaagaaattaaagagttgtgtcagagtcataatattcctgttgaattaatccagtgtcgggttaatgaaatagagacctatatggatggcgtgcatttgatatgtactaccgccaaagttgaccgtagttttggcgatattccgttagttcacggcatgccttttgtttctggtgtcggtatcgaagcattacaaaataaaattctgactatcttacaggggtgacctatgttttcagaagtcatgcgttatattctcgacctcggccctacggtgatgctgccgattgtcatcattattttttctaaaatattaggcatgaaggcaggcgattgctttaaagcgggtctgcatatcgggattggctttgttggcattggccttgtgattggcttaatgctggattccattggtccggcggcgaaagcgatggcggaaaattttgacctgaatctgcatgtggtcgatgtcggttggccgggctcttcaccaatgacctgggcgtcgcaaattgcgctagtggcgattccgattgcgattctggttaacgtggcgatgctactgacccgtatgacgcgggtggtaaatgttgatatctggaatatctggcatatgaccttcaccggcgcgttgctgcatctggcaaccggttcatggatgatagggatggcgggtgtggtaattcacgcggcgtttgtttataagctcggcgactggtttgcccgcgatacccgaaatttctttgagctggaaggcattgctattccgcacggtacgtcggcgtatctggggccaattgcggtgctggtggatgctatcatcgagaaaatcccaggcgttaaccgtattaaatttagcgccgacgatattcagcgcaaatttggtccgtttggcgagcctgtcaccgtgggttttgtgatggggctgattatcggcatcctcgcgggttacgatgtcaaaggtgtattgcagctggcggtaaaaacggcggcagttatgctgctgatgccacgggtgattaaacctatcatggatggtttaacgcccatcgctaagcaggcccgtagtcgtttacaggcgaagttcggcggtcaggagttcctgattggccttgatccggcgttgctgctggggcatacggcggtggtatcggcaagcctgatttttatccctctcaccattttaattgctgtttgtgtgccgggtaatcaggtgttgccgtttggcgatcttgccaccatcggcttcttcgtggcgatggcggtcgcggtgcatcgtggaaatctgttccgcaccttaatctcgggtgtcatcattatgagcatcaccctgtggatcgcgacgcaaactattggtttgcacacccaactggcggctaatgctggggcgttaaaagccgggggtatggtggcttcaatggatcagggcggttctcccattacctggttactgattcaggttttctccccgcaaaatattcccggtttcattattatcggtgccatttatcttaccggtattttcatgacctggcgtagagcgtgtggttttattaaacaagagaaagccgttctcgcagaataatttttacctgagggggagtttatcccccttaacaatcaggagtttttatgaaatcagtggtgaatgatactgatggtatcgtgcgcgttgcagaaagcgtcattcctgaaattaaacatcaggatgaggtacgggtaaaaattgccagctcgggcttatgtggttccgatttacccaggatatttaaaaatggtgcacattattatccaataacgttaggccatgaatttagcggctatattgatgcggtgggatccggtgttgatgatttacaccctggcgatgcggttgcctgtgtgccgttattaccctgttttacttgtccagagtgtttgaaagggttttattcccagtgcgcaaaatatgattttattggctcacggcgtgatggtggatttgctgaatatattgtcgttaagcgaaaaaatgtctttgctctacccacggatatgcctattgaggatggggcttttattgaaccgattaccgttggcctgcatgcttttcatttagcgcaaggttgtgagaataaaaacgttattattattggtgccggaaccattggcctgctggctattcagtgcgctgtcgcgctgggagcaaagagtgtgacggctatcgacattagctcagaaaaactggcactggcaaaatctttcggtgcgatgcaaacatttaacagccttgaaatgagcgcgccgcaaatgcagggcgttttacgcgagctgcgctttaatcagcttatcctcgagacggctggcgtaccgcaaactgtcgaactggcggtagagattgccggtcctcatgcccaactggcgctggtgggcacgttgcatcaggatctgcatttaatatcggcaacgtttggcaaaatattgcgtaaagagctgacggttatcggcagttggatgaactactccagcccttggccggggcaggagtgggaaacggcgagccggttgctgacagaacgtaagttaagcctggagccattaatcgctcaccgtggaagctttgaaagcttcgcccaggcggtgcgtgacatcgctcgtaatgctatgccgggcaaagtgttgcttattccctgaaaccgcgggccagcgtgatgctggcccggtattgtgcaaaacagatcattcaccaatggtcccccttcgtttacactagccacaattgaatatgggtaaatgacgatgaattcattcgagcgaaggaataagatcatccaattagtgaatgaacagggaaccgtgcttgttcaggatctggcgggagtatttgctgcctcggaagcgacaatccgtgccgatttgcgctttctcgaacaaaaaggcgtggttacgcgctttcatggcggtgcggcgaaaataatgtccggtaatagtgaaaccgagacccaggaagttgggtttaaagagcgatttcagctcgccagtgcgccaaaaaacagaatagcgcaagcggcagtcaaaatgatccacgaagggatgaccgttattctcgacagcggaagtacgacaatgcttatcgccgaaggtttaatgaccgccaaaaatatcacggtgattaccaacagtctcccggcggcgtttgccctttccgaaaataaagacattactctggtcgtctgtggtggcaccgtccgccataaaacgcgctcgatgcatggttccattgccgagcgttcattgcaggatattaatgccgatttaatgtttgtcggtgctgatggtattgatgcggttaatggtattacgacctttaatgaaggttattcgattagcggggcgatggtcacagccgctaataaagtgattgccgttctcgattcatcgaaatttaaccgtcgcggttttaatcaggtactcccaatcgaaaaaattgacattattattaccgatgatgccgtgtcagaggtggataaactggcattgcagaagacacgggtaaaattaattacggtgtagtattgttctgtatgccggataaggtgtttataccgcatccggcattacggattctccctggttcaagagagaatagtgtgattaacgcaacaatgggcaatctggtggtaatcgacaacgcaacgccgccggaagtatttcaatatgaaagttttgtccgctcaacggttcgccatcaagattaaaagtgatttcgtgtggggcttgtatatcaaaccacgacgaagcgccttcgataatattcgggttatcttcgtcagattttaatgttgatacgagagccggaagaatttcatcgccggtaaaaatgcgcagttgcagcaagccatcgttaattaacgcgttcgggcacaattgctgaccgccaccggcctgacgcccgttaccaataccaatgaccagggcgtcaccttgccagtgaaagttttcaccgcggatctcacaacggtccggttgcagagtatccatgcgcattaagccatgaatgatgtaagagacgccacccagcgcggcttttaatttttccggcgtttctgtggtaatacgcgtcccaaatccgcctgtcgccatattaataaaacaggtttgtttgttgacctgcgccatatctatcgcaatggcgtcaccggcaattgccagtttcagcgccttatccagtgcctcaggaatccttacactggtggcaaaatcattggcggttcctaatggcaaaattcctagcgcgggtatgtcatccccctcacactgaatcaacgccgtagaaacttcattaatggtgccatcgccaccaccggcaatcaccgttgcgacgcccaacttccgggcctcctctacatatcgtgcggcatcgcctttctcccaggtgacccgcacatggatcgtcattccttcctcacgcaacagcataattgcttcgcgcaatggtaaattgtcagtacttttgccattaagaatcagtaagctggcgggaaattctgccatgatcgtatgtgcctttatgattggtctgtagatagtgtagagcagaaaagaaaaggtggagtcagaacaggatgaaagtcggaggataaaaaatcagttcaagtatagaggattcagtggttaccaccaggagcttgcaatggggacagtgaatgttaacggtagccataggtaaatttcaaaaaagagcatatacctaatattcaactaaacagtggcatcttcaatatactattaaaaatatattaacccccccatggggttacccggaagggcctccgtgtatgtaattcctacttatgtaggaaatgttgtacagaacatttattataatcctattcaattataataatcatgccattattatattttaacaccagagcgtgtcgttggtatttaatgggggaaggtaagatgaaaaagatagctgctatatcattaattagtgtttttcttatgtctgggtgtgctgtacataatgatgagacaagtatcggtaaatttggtcttgcatataaaagtaatattcagcgtaaactcgataaccaatactacaccgaagccgaagcttctttagccaggggcagaatttctggtgcagaaaatatagtaaaaaatgatgcagctcatttctgtgttactcagggcaaaaaaatgcagatagttgacctgaagacagaaggtgcaggattacatggcgtcgctcgtctgacattcaaatgtggagagtgagaatattttttggtaagcgtcaaacatgcgcgttctggttgtgcgtagccggaatctgtacgagcacgatgccgttacgtgaaaggcatcgtgttatgaagggggattctatcgatgtggtcaatggaagacggtgaccaggatacggcttatgcataaaaaataagcccgtgtaagggagattacacaggctaaggaggtggttcctggtacagctagcattttatgggttatgtttttcagcgaaacggatgataaccttaataaatgcagctgtatgtgatcggtttctaagaattttccatccgggaaaaataatcgaaattaatcacttaccgtgggggttacgcgtggtttccccggagaaattacgcatcaggagcgcgtaatttagctcaagatcctgcgggaccgggagccacacagtataaccatcgcctggtgcgaccggcatagcttcacctttggcgttttccatgtgctcaagggtaaagttaatgttgccttgcggcgtcatcagctcaaggctgtcaccaacggagaatttatttttcaccgctaccgccgcgaggtcgcccttgcgctcaccggtaaactcaccaacaaactgctggcggtcagaaactgaataaccgtattcgtagttctgataatcgtcgtgagtatgacgacgcaggaaaccttcggtatagccacgatgcgccagaccttccagagtttccagcaggctggtatcgaatggttttcccgcagctgcgtcatcgatagctttacggtaaacctgcgcggtgcgtgcgcaatagtagaaagatttggtacggccttcgattttcagcgaatgcactcccattttggtcaggcgttctacatgggcgatggcgcgcagatctttcgagttcatgatgtaagtgccgtgctcatcttcaaacgcggtcatatactcgcccggacgctgggcctcttcgatcataaacactttgtcggttggtgcgccgatacccagcgtcggctcaacattttgcaccggaatcggctcgtacttgtgtacgatgttgccaacgtcatcttctttcccttcctggacgttgtattcccagcggcaggcgttggtgcaggtgccctggttcgggtcgcgcttgttgatatagccagagagcaggcagcgaccggagtaggccatgcacagcgcgccgtgaacgaagatctctacctccatatccggcacctgattgcggatctcttcaatctcttccagcgacagctcgcgagagaggatcacgcgggtcaggcccatttgctgccagaatttcaccgtcgcccagttcacggcgttagcctgtaccgagagatggatcggcatttcagggaagtgctcacgcaccagcataatcagccctggatcggacataatcagcgcatccggccccatttccaccaccggtttcaggtcacggataaaggttttcagcttggcgttgtgcggtgcaatgttgaccacgacataaaactttttccccagcgcgtgggcttcattgatgccgagctggagattttcgtggttaaattcgttgttgcgcacacgcagggagtaacgcggctggcccgcataaacagcatctgcgccataagcgaaagcgtaacgcatatttttcagcgttcccgccggggaaaggagttccggtttaaacataattctctcgttctgatgacaggtcagatccgcttcacctgatgaagcggccaggggagtgcccccactttaagggcgggcattgtagcgctgtaggggggagctggtaaagcgccggacgccaacaacccacgcccggcatcgtaattacgtattgtctttcaccgtctggcttgtgccattggctttaacggaggcaattccggtttcacgagattgcgcggtggcgtacatctggctggagccgataatttgatgattagcggctttcagattgaaatagaatttgccgttgcttgccgtttttttctcatagcgttcttcttgcgggctgttgctacgcaccgacgcgatgcccttttccgcagaggcttttgaggtatacagctcgctggtaaggatagtctcaccattgcccgcttttagcacaaaccgaaattgattatcactgcttttactgagttcaaaccaaccagccataatgactccttgattgaaattgcgtatcgaaaacagcatctaaaaggactgtttaccgattaaagtatgagcgattttctggtgcctgccagggcggagagataatgtcagtttgctgaccatgcgtgggattatgttgccggatgcggcgtgaatgccttctccggcaggtaaaaatgttaaacgatgcggcaggcgtcggcttcccagcggtaaccgacgccgtaaacggcacggataaaggactgttcggcgtcgagagattccagcttgcggcgcaggtttttaatgtggctgtcgatggtgcggtcggttactacgcggtagtcgtcataaagatgattgagcaattgctcgcgggagaacacttttcctggttcatgagagagcgttttcagcagacgaaattccgcaggcgtcaggtcaagcattttaccgcgccatgaagcctgaaaacgaccttcgtcgataatcaacgggctttcagcatcctgttgctgcaactcacgctgcggtttgcaacggcgcaaaatggttttgacgcgcgctaccacttcccgtgggctgtacggcttacagatataatcatctgcgccaatctccagtccgagcaggcggtcgatctcttctatttttgccgtcaccatcacgataggaatgtcagaaaaacgacgaatttcccggcacagcgtcaagccatcggtgccagggagcatcagatccaacaggatcagatccggtggtgtctggcgcacatacggcagtacctgatcgccgtggctgataagcgtcggcgcatagctcgcagcacgcagataatcaatgagcaactgtcccagcttcggttcatcttccacgatcaaaatacgcggtgtgttttcgtcgattggtaactcggtcatacttctctctgtaaatcccgttccagcggtaactctactgtaatgcttaccccgccaaaaggcgaatgggcagcaataatgcgaccattatgtgcttcaacaatgttcaggcaaatcgccagccccagcccggaaccgccgctggctcggttgcgggaaccttcggtgcgataaaaacgttcaaacaatttttgtagctgatcgtcactgacgcccggcgcgctgtcggcaaaggtcagtcgcaccgttttgtcgtgctgcccggcagagattttcaggctaccgccgctgtcagtgtagcgcaggctgttttccagtaagttattgaataactgcattaaacggtcgcgatcgccaaatacggtaatactgtctggcagggaaaattgcagtttcaggccacggctggcgaatcgttcgcgaaatgcgccgcccgccacttccagcagtgggatcaaatctaccggtgctttttgataggcgagagcgccttcatcagacatcgacaactgatggagatcgtcaaccagtttggtcagtgtaccgacctccgcctgtaaagacgccaccgtctccggcgtgaatttacgcacgccatcctgaatggcttccagttcaccgcgcagcaccgctaatggcgtacgcagttcgtgagaaatatcggccataaaatcgcgccgcatttgctggtttttctccagcgtgctggcaagctggttgaagtcttgcgccagtttgcccagttcatcttcactggtgggcgttacgcgggtagtgaaatcgcccgccgccagtttgtgcgtgccgtccaccagccgttttaccggtgccagcaaaccacgcgccagcagaaaggtagcgagtgccgcgagtaacgttgccagagcaacaatcagccagctggtttgccgctgttgtttatcgaaattgatatcagtattgcgggtcagtcgctcaacaggggaggcaatcaccgcacccacttccgcaccgttgaccagaatgggtcgccgtgtaccgtcaggtggaatcggcgctcgcggaccaaccagcactttgttgttttgatcgaccacccagaactgggtacgccagccgtgcggcggcatacccgggccgggtttatcttccgaattatcgtgttcaaatgaacgcaagatctgaaagacaaagcgatcattgttgcgcaggaagcgccagttgccatgctgcgcatactgctcgccaagcgcatcacttaacagttgtaatcgctgttcattaccatgcttgatgtaatcaataaagccacgctcaaaactgatacgcaccgcccagtgcatactgatcagcaagacaatgcaggtggcgaaaatcgccagaaacagtttgccggtaataccgggtcgccagaacttcattgcgcgctcctttttcgccgcgaaatagctacattttgatgcgtatcgttcggcactctggcaaagatgaacgccggaagggcgatgataaacgccatgctaagccaggtgtacataaagacggtttgtgtggtgccgctgtcgacgctgacatgctgcgaaccaaaaagtcccagcaacagcccggcgatggtgacgccgatactcatcgacaattgcataatcatcgacagcagactattgccgctgctcgccagattgtccgggagatctttcagcgtcagggtgttcatggaggagaaacgcgtcgagttgaccatcccttgtaaaaacaggacgaacggcaaaacgtagtaccagcccagcagagcggtagtcataaacaacagggtgaccagcgacagacccagcgtggttgccaccagtacccgacgataaccaaagcgattcactacctgtaccacaattcgcttcatccccatgctgccgagcaccatcgggatcatcatcagtccggcatgaaacggtgagaagccaaggccaatttgcaggaaaaccggtgtcataaagggcaacatgccgctaccgatacgtccggcaaaactccccgccaggcccagcgaaaaggtacgagtgcggaacagtttcagactgaaaagagcgcggttgttatttctggcgtgcagcagataaagcaccagtgctaccacgccaacagcgaccaggccagtaatcgccagcggcgataaacctgtacctttactgccatccagcgccagggttaataccgccatgccaatcgccagcaataaaaagccggagagatcgaagcgccgcgtctgcatggtgtagttcggcattaacattagtgtggcgatcgcgccgataattcccaccggaatgttgatcaaaaagatccagtgccacgacgcgtactccaccagcaggccgccgagcgccggaccgagcagcggaccgacctgaccgggtaacgtgacaaaggtcatcgccgccatatattgctcgcgcggtacgattttcatcaccgtcaacctgccgaccggcaccatcatcgcaccgccaacgccctgtaacgcgcgtgccagcaacagttcgttcagcgtgccggaaagtgcgcaaaatagtgaaccgagagtaaacagcacgatggcggtaaagaaaatattgcgcacgccgactttgtccgccagccagccgctggcaggcaacatcaccgccacggtcagcacataagagacaatgaccatgtgcatatgcaacggactttccccgaggctttgcgccattgagggaagcgcggtgttgacgatggtggtgtccagcgactgcataaagaagccgaaagccacaatccacaattgccagcgggtgttgtcgggaagatctgtcatttactctgttaccgtttgtttaggtttacgcgaaaaacgcagccgcagacggtcgaaaaagagatacaccaccggcgtggtatacagcgtcagaagctggctcattaccagaccgccgacaatggtgatccccaggggttggcgcagctccgagccgtcaccgcccgacaacaccagcggcagcgcaccaaacagcgccgccagggtagtcatcataatcgggcgaaaacgcagcagacaggcctggaaaatagcttcctgcggcgtcaggttaccgtgccgttgggcttcaagcgcaaaatcgaccatcataatggcgtttttcttcacgatgccgattaatagcatgatccctatcagggcgattaggctgaacggggcattgaacagctccagcgccagcagcgctccaacgcccgccgagggcagggtggagagaatcgtcagcggatgtacgtaactctcgtaaaggatacccagcacgatatacaccgtggcgatggcggcgataatcagaatcacctgcgagttcatcgtctcctggaacacctgcgccgtgccggcaaaactgccgcgtaccgtcgaaggcacaccaagctgggtcattgcgcgatcgatcgccgcactggcgtccgagagcgatttcccggtcggcaggttaaacgaaatggtcgaggctgccgataatccctgatgattcaccgacagcggagcattcgccggttgccatttagcgaaatacgacagcgggatcgcttttccttcgttattgataacgaacattttttccagcgcactgatgtcctgggtatagcgcggatccacttccatcaccactttatactggttcatcggctggtaaatggtcgagatctgccgctgaccgaaggcgttatttaacaggctgttggcggcctgcacgtcgattcccagccgtgccatggtgtcgcggtcgtaaaccagattcatctccgcgccgttatcctgctgatcggagttcacgtccgccagttccggcaacgtcgccagttttttgcggattttcggctcccattcgcgcagtgccgccaggtcgtcggataacaacgtgtactggtagctggcgttcgactgacgcccaccaacgcgaatatcctgtaccgccatcaggaacagattcgcccccggttctttcgccagctttacgcgcagacggtcgataatttgctgcgccgtttcgctgcgttcgtcgtgtggcttgagggtgataaacatcatcccactgttcacccgcgaaccgccggtaaagccggtgacattatccaccgccggatcgtcacggataattttcataaaatcctgcaacttgccgcgcatcgcctgaaacgaaatactctgatccgcctgtatcccgcccatcagtacgccagtgtcctgctccgggaagaaggttttcgggatcgagatatatagccagatattcagcgcaatggtgccaagcaacaccacgcccaccagacgggtatgattaagcccccatttcagcgacttaccatagccttgttgcagggctaccaacatgcgaccaaaaccacgtagtcgcttttgctcgcgcggcttgctggcttttagcatccagccgcacatcatcggcgttagcgtcagggaaaccagcaacgaaatcccaatggcgacagaaagcgtcacggcaaattcgcgtaacagtcggcccggcaatccgcccatcaacagcagcggcaggaacaccgccaccagtgacagactcatcgacagcaccgtaaaaccgacttcgcgagtgccttgcagcgcggcctgtagcggtttcatccccgcctccagatgacgggcgatgttttccagcaccacgatggcgtcatccaccacgaaaccagtagcgatggtgagcgccattaacgaaagattattgagactgaatccgcacaggtacatcgccgcaaacgtaccaatcagcgaaaccggcaccgcaacggcgggaataatagtggcgcgacccgagcgcaggaataaaaagaccaccagaatcaccagcgccaccgagataatcagcgtttgctcgacttcttccagcgaggcgcgaatggtgggggagcgatcctgagcaatttgcagatcaatcgccgccggaatggtttcctgcaactccggtaattttgcccggatgctgtctaccgtctggataatattggcttccggcagcttgcggatcatcagcaaaatagccggtttggcgttggtcatcccggcgttgcgcacatcctgcactgagtcggtcaccgtcgctacatcgcccagacgaaccgcgccgccgttgttgtaatgaataatcagcggctgatattcagcggcagttttcagttcatcgttagtctggatctgccagcggtgagtgccatcttccagcgccccttgcggtttacgcacgttggcattgctgatggcagtgcgtacgtcgtccagcgagacgccctgattaaacagcgcctgcgggttcagcccgacgcgcaccgcaggtagcgagctgccgccaacatcgacatcaccgacaccgtcgatttgcgaaatcgtcggagccagctgcgtcgaggcaaaatcgtacagttcaccttgcgaataagtatcggatgttagcgtcaggatcataattggcgcatccgacgggttcgctttgcgataggtcggacggcttggcatcccgctgggcagcaaactttgcgcggcgttgatcgccgcttgcacatcgcgcgctgcgccgttgatatcgcggtcaaaatcaaactgcaaaataatgcgcgtgctgccgagcgaactgctggaggtcatttcactgaccccggcaatgcgcccaagcgaacgttccagcggcgtggcaacggaagacgccattgtttctggtgacgcaccgggcagcgaggcgctgaccataatcaccggaaaatcgacctgcggcagtggggcgaccggcagcatacggaagcccagtatgccgcacagggtaatggcgaccgacagtaaaatcgtcgccaccgggcggtaaatgaagagggcaaaaaacttcacttacgcctcctcttcatgacgagcaaagcggcttttggtccacaatgccaggcggtcgaacagcaaataaatcaccggcgtggtaaacagcgtcagcacctggctgactatcagaccgccgaccatgccgatacctaacggacgacgcagttccgcgccgaccccggtacttaacatcagcggcaacgcgccaagcagagccgccagagtagtcatcaggatcggacgaaaacgcaacagacaagcctggtagattgcatcgcgcggcgacatgccttgctcgcgctcagcagccagcgcgaagtcgatcatcatgatggcgttcttcttcacgataccgatcagcaaaataatgccgataatggcgattacatccagttcgctaccggcaatcagcaacgccagcagtgcgccgacccctgccgttggcaacgtcgagagaatggtgatcgggtgaataaagctttcgtaaagaatgccgagtacgatatacatcgccaccaccgccgcgacaatcagccagacagtgctgcccagcgccgactggaaggcgagggtgctgccctggaactgcgtggtgatatccaccggcagattcagcgtcttttcggtgtccataatcgcctgcaccgcatcgcccagcgaatagttatctggcacgttaaaggagatggtcgttaccgggaactgatccagatggttgatggagagcggcgcaaaacgctgctcaattttggcaattgagcttaacggcaccacgccaccgtcgctgctggtcaggcgaatggtatccagcgccgcgaggcctggggtattttcagtgttgtgttccagcaccacgcgatactggttagcctgagtataaatagtggaaatcagccgctgaccaaacgcgttgtacagggcgttatcgacatccgccatgttgatccccagacggctggcgctgtcgcgatcaacattgacatacgccaccagccctttgtcctgccagtcgctggagacatcagaaagctgtggcagttgctggagtttttccatcaactgtggcacccaggtactgagcgcatccagtgacgtggcctgcaaggtaaactggtactgggtgcggctgacctgagtatcgatggtcaggtcctgcgttggttgcaggaagagatcgacgcccggcactttatccaccgccgtttgcagacgggcgatgactttttgcacccgatcatcacgttcatccaacggtttgaggttgatctgcaaacgcgcactgttcagcgacgggttagtgccatcaacgccaacaaatgaggtcagactttgcactgccggatcctgcaaaatcacatccgcgacctggcgttgccgctgggccatattggtaaaggagctggattgcggtgcctgcaaagtaccctgaataatgccgttgtcctgtaccgggaagaaacctttcggaataaacacccacaagagaacgctaagcagcagcgtgctgagcgctacgcttaaagtcagccacggatgattcagcactttcgccagtccgcgaccataggcggcgattatcctttcgaacattttctctgaggcacgggagaagcggttctgtttacgcagcgactcctggctgagcatccgtgcgcacatcatcggcgtcagggtcagcgacaccacggctgagatcaaaatcgctaccgccagtgtaatagcaaattcgcggaacagtcgcccgacgatatcgcccataaacagcagtgggatcaacaccgcaatcagtgagaaggtcagcgagataatggtaaaaccgatttcacctgcgcctttgagcgccgccgccagcggtttttcgcctttttcgatatagcgggaaatgttttcgatcaccacgatggcgtcatcgaccacgaatccggtggcgatagttaacgccatcagcgtcaggttattgattgaaaaatcgagaaacaccataaccgcaaaggtgccaattaacgacagcggcactgcgacgccaggaatgatggtcgccggaatattgcgcaaaaacaggtagataatcatgactaccagcgcgatagccatcatcagttcaaactgggtatcgttgaccgatgcgcggatattggtggtacggtcagaaagtaccgtcaccttcaccgatttcggcagactctcggtgagctgtggcagcatctgccggatgctgtcggcggtggagataatgttagcaccgggctggcgctgaacattcatcacaatggcctgttctttatttgcccacgccccaagccagctattttctgcaccttgctctacggttgcgacatcgcccagacgaatcggtgcgccgttctggtaggcgatgattagctggcgatattcttcggcggattgcatctggtcgttcgcggaaagcgtgaccgcacgggaagggccgtcgaggctacctttagccgagttaacgttagcaccggtaatggcggtgcgcacggtttcgctggtcaggccgagggcggcaatcgcctgggcgttaagtttgacgcgaacagccggacgctggccgccggaaagcgtcaccaggccgacgccggaaatctgcgagattttctgcgcgacgcgggtttccaccatatcttccacttgcgtcatcggcatggcggttgaggtgacagcgagcgtcatgattggcggatctgccgggttcactttgctgtaaaccggcgggttaggcagatcgctcggcaacaggttggtcgcagcgttaatcgcggcctgcacttcctgctcggcgacatccagcggtaatgttagctggaactgcaaagtgataactgacgcaccgccggaactttgcgacgacatctgtttcaggccggacatctgcccgaactggcgttcgagcggtgcggtaacggcagaggtcatgacatctgggctggcacctgggtagagggtgaccacctgaatggttggatagtccacttccggcagcgccgaaacgggcagggcacgataaccgataatcccggcgagtaagatcgccaccatcagcagcgtggtggcgacaggacgcataataaacaggcgcgacgggccgcctgtgctgctcgggggtaacacctgcatcaggagcgtgctccttttttcgcgtattcgcggctggtggctttctcttccgaagtggtggcgctttgagcttctaccacttccactttcgccccttcggtcaggcgatcaattccgtccgtcactacgcggtcgcccgcagaaatacctgcgcggatcaccactttctgactgtcctgaatgcccggcgtcaccagatgtttgctgaccttgttttcgctattcagcacccagacaaaatggccttcattgcccatttgcagggcggcggtggggatcaccacggcgttttgttcggtgtcgactaacatacgcgcgttaacaaactgattgggaaacagtgcatcatcctgattattaaagcgtgctttcactttaatcgtaccggtagtggcatcgatttggttatcgaggcttaacagcgtgccttcacttaatttcttcgagttggtgcgatcccaggcttcaacaaccagcggttttccggctttttgcgcctgtactacggtagcgatatcgctttccggcagggtaaagactaaatcgatagggtgcgtctgggtgatcaccacaatcccggtggtatcaccactggagatttggttaccaacatcaacctgcttgagaccaacgcgaccatcgactggtgcggtgatgcggctccagtcgagttgcagctgcgcgctggcgacgcttgcttcatcagccttaatggtgccttcggtttcactgaccagcgcctgttgggcatccagctcctgacgagatacgagattggtttttaccagttgttgataacgcgccaggtcacggcgggcgttggcaagcgtggctttatcttttgccagttggccctgggcttgtgctaatgcaactttgaactggcttgggtcaatttctgccagtaaatcgcctgctttgacctgctggccttcctggaaatgtaacgctatcagttggccgtccacgcggctgcgcaccgtaacggtattagcggcggtaatggtgccaagcccggtgaggtaacgcggaactgcctgttctacggcggtcgccgcctgaaccggggctaatgggccggaacgcataccacggcgaccacccgctggcgattgctgcgcttgtttcgtcgcccctggggctgcactccgggagtcattgcggccttgccagaaccagaatgcggcgatggcggcgataaccaccacgattacgattacccaacgggatttataactgcctttcatcgttaagagtttctcttcctgaaacgtttcgcggaatgatactagtgtagccagccaataagggagaaaaatggaggaattatgaaacactgtcgggaatcgtctgaatgacgggcacatttgcgagcacgcatccagtaataacacatgaaactattttatctacgcgttagcgatagactgcttgcatggcgaaaggaggtaagccgacgatttcagcgggacgctgaaacgggaaagcccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcgaaaggaggtaagccgatgatttcagcgggacgctgaaacgggaaagcccctcccgaggaaggggccttaaataaggaaagggtcatgatgaagtggatcatcatcgtggtgctcttagtcataagcttcccggcttactaagactaccagggcgggggaacccccgctctaccctcactcctgaaagtatgccttcacgataagattgtcaatctgcaggctttgcagtctgcgatcctgccagcaaatattctttgcgagacgttacacaataatcacatgtgaaactattttatccgcaagtcagcgatagactgcattcagggcgaaaggaggtaagccgatgattttagcgggacgctgaaacgggaaagcccctcccgaggaaggggccttaaataaggaaagggtcatgatgaagtggatcatcatcgtggtgctcttagtcataagcttcccggcttactaagactaccagggcgggggaacccccgctctaccctcactcctgaaagtatgccttcacgataagattgtcaatctgcaggctttgcagtctgcgatcctgccagcaaatattctttgcgagtcgttacgcaataatcacagaggaaactattttgttcacgcgttagcgatagactgcattcagggcgaaaggaggtaagccgacgattttagcgggacgctgaaacgggaaaccctctcccggagaagagggcttttaataaggaaagggttatgatgaagcacgtcatcatactggtgatactcttagtgattagcttccaggcttactaagaacaccagggggagggggaaacctctccctaaccctcactcctgaaattatgtcactccgcccttagtgtcaatcgacggctctccgttcttgcgaggcgaatagcaaaattttctgcgccgccgggcctaattctgaaagtttcttcgtttgctcttatttcattattgcaatcggtatgataccggacctcaataattctctaagaaaggatttcttatgagcgaacaaatcatgtttgccaccagcgattttgccagtaacccggaaccacgttgcccctgcattttgctgctggatgtttctggttctatgaacggtagacctattaatgaacttaacgccggattggttacctttcgcgatgagctgcttgccgattcgctggccttaaaaagagtggaactcggcattgtgacgttcggcccggtgcatgtggaacaaccctttaccagcgccgctaattttttcccgcccatcctgtttgcccaaggcgatacaccaatgggggccgccattaccaaagccctggatatggttgaggagcgcaaacgtgagtatcgcgccaatggtatttcctattatcgtccgtggattttcctgatcactgatggcgcaccaaccgatgagtggcaggctgccgccaacaaagtgtttcagggggaagaagataagaagtttgccttcttttccatcggtgttcagggggcggatatgaagactttggcacaaatcagcgttcgtcagcctttgccactgcagggattacaattccgtgaactgtttagctggttatccagttcgctgcgttcggtttcccgctccacgccgggaacggaagttgtgctggaagcgccaaaaggctggacgtcagtgtgagctggcgtctggtctatgcatcaaccgttggaacgtcgcacatcagcgcggacttgccttgccaggatgcctgccagatgcaggttgcctggttaaatgaccagcagccattattgtcggtatttgtcgctgatggcgcaggcagtgtctcgcagggtggcgaaggcgcgatgctcgccgtcaatgaagcgatggcttatatgtcgcaaaaagtgcagggcggggaattggggcttaatgatgtcctcgccacggatattgtgctgaccattcgtcagcgactttttgccgaggcggaagccaaagaattagcggttcgcgattttgcctgcacatttctgggactgatttcatcgcctgacggcaccttgattatgcagattggcgatggcggcgtggtggtagatttggggcacggtctgcaactgccgctcacgccgatggtgggtgaatatgccaacatgacgcacttcattaccgatgaagatgcggtttccagactggaaactttcaccagcactgagcgtgcgcacaaagttgcagcatttacggatggtatccagcggctggcgttaaatatgctggataattctccccatgtgcctttctttaccccgtttttcaatgggctggcgtcagcaacgcaggaacaactcgatttattacctgaattgttaaagcagtttttgtccggcccggcggtaaacgagcgtaccgatgatgataaaacgttggcactggcgctgtggacagaatgaacatcgcatggcggttgaagacaacagttcaaccgccagtttaagcaattaatataatggctggttagcgaactaattttgctcttagctcgtcggcttcttcttttggataggtgaccaataaaggaacaatggtataaccgccgtaaattttatccccgcgcgtatacatccagtctgaaatatcttctttcttgattttccactcctgaccatattctacgtttgtaacaataccagggtcattgcttattacgccaataaacatgccgttagaataagtgacatccgtaagccagaaatgctctgttcttccgtgatcggttatcggggctttgaccgcgaaagtatcggcatcttttttattcataatttcgatgaattgatcggtttctttccgcgcatgttgaatggcgtcagacatcgcttgtttatcataacctcccgtcactaacgtatccgaaacttcactaaagcccgcggtagtaaaaaatagcagactcaacataagtaatatctttttcatcttttttccagaatccctgtgtagtaaaagttagcaaaaaatctgtggaagtgaatcattatcaggttggaattgaattgtatcctgatgaaattgcattatcatttttattcttgagtgggactcttccaatatggaaataattataatgggcagtgttattattcattaaaatataatatgactgcccttaaaacattatgaagacaaatataaaagtatttacatcgacaggtgaattgaccactctcgggcgtgaactgggaaaaggtggcgaaggcgcggtttatgatatcgaggagtttgtcgatagcgtcgccaagatttatcacacgccgccacccgccttaaaacaggacaaacttgcctttatggctgcgacagctgacgcgcaattgttgaattatgtcgcctggccgcaggcaacgcttcacggtggacgaggcggaaaggttatcggttttatgatgccaaaagtttctggtaaagaaccgattcatatgatctatagcccggcacatcgtcgccaacgttaccctcattgtgcgtgggattttctactctatgttgcgcgcaatattgcttcatcttttgctacggttcacgagcacgggcatgtcgtgggtgacgtaaaccagaacagctttatggtaggccgtgacagcaaagtggtgttgattgatagcgactcctttcagattaacgccaatggcacactgcatttatgcgaagtcggcgtgtcgcattttacgccgccagagctgcaaaccttgccatcatttgtcggctttgaacgcacagaaaatcacgataattttggccttgcgttgctgatttttcacgtcttgtttggtgggcggcatccttattctggtgtgccgcttatctctgatgcggggaatgcactggagacggatattgcccatttccgttatgcctacgcgtcagataatcagcgacgtggtttaaaaccgccgccacgatctattccgctgtcgatgttaccgggcgatgttgaagccatgtttcagcaggcattcacggaaagtggcgtggcaaccgggcgtccgacggcaaaagcgtgggtagcggcacttgattctctacgccaacagttaaagaaatgtaccgtttcggcaatgcatgtttaccccggtcatttgactgactgcccgtggtgtgcgctggataatcaaggcgttatctattttattgatctcggcgaagaggtcattaccaccggcggtgattttgtgctggcgaaagtctgggcaatggtgatggcgtcagtagcaccaccagcattgcaactgccattacccgatcatttccaggctgctggcaggccgcttcctttaggcctgttacggcgtgaatacatcattctgattgagatcgcactgtcagcgttatcgctgttgctttgcggccttcaggcagaaccgcgttatattattttggttcctgtgctggcggctatctggattattggcagcctgacaagcaaagcgtacaaagcagaaatccagcaacgtcgtgaggcgtttaatcgcgcgaaaatggactatgaccatttagtcagccagatccaacagttgggcgggctggaaggttttatcgccaaacggacgatgctcgaaaaaatgaaggacgaaatgctcgggttaccggaagaagagaaacgcgctctggcagcacttcaggacaccgcaagggaacggcagaagcagaagtttctggagggattttttattgatgttgcctctattcccggcgttggccctgcgcgtaaagctgcgttacggtcctttggtattgaaacggcggcagacgttacccgacggagcgttaagcaagtgaaaggttttggtgatcatctgacccaggcggttatcgactggaaagcgagttgcgaacgccgttttgttttcaggccgaacgaagcggtaacgcctgcagacagacaagcggtaatggcaaaaatggccgccaaacgacatcggctggaatcggcgttgactgtcggtgcgacagagttgcagcgattccgccttcatgctccagcacggaccatgccgttgatggaaccgttacgtcaggcggcagaaaaactggctcaggcgcaggctgatttaagccgttgctgaaccagttttcaattaacgaaacaccacttccgcccagcgtgcgagcccggcggtgacggagccaaagtcatcgccacctgcaatcggaatgcccggcaactgttctgtcagcgcttttttaatcagcggtgaacgggcgctaccgccggtcagatagataacatccggtttttcctgggcgttatccagcgccagttgcacctgttccagaatccgcgccagtggctggctgagggcgctttccagcccttgctggctaatcagcgtagccagttcatcgctgataaacggcagtgaggcgcgggtttccgctacgcttgaaagcgcaattttgctctcttctgcgctacgtaccaggcgatagcttaaacgctgacgccagactttctgtaacagggccactttttccggttcgcgggcatcgcgtaccaggtcgttaagcagacgaccgttggcactactgtagaaatcactctgtgcaggaacgtcgttgatggcaaccgcattccaccacggcagaataggcagggcgatgcctttttcggtttcgccacccatgcccagtaacggcatcaggtttttaaacgccagcgcgatatccagatcgttaccgccaatacggcaaccactgtgacccagcaggctggcttcacgatcgagacgcgaacgccactgcggccccatcagcagcaatgaacagtcagtcgtaccaccgccgatatccaccaccagcacccgtttttcttcctgcaaggtggcttcgtaatccagcccagccgcgaccggctcgtactggaataccacatccttaaacccggcacgcttcgccgcgcgttccagaatcccctgcgcctgggtgtttgcttcatcgccgccaagcccctggaagttgatagggcgaccaatcaccgcctgagtaatcgcttctggcagctgtgcctgcgcctgctggcgaatgtgcaacatcattgcgcagaccagatcctcaaacagcgctacctgctgcggttttaagccgctggcaccgaggaacgattttggtgatttcacaaaccacacttcttctggatcatcaatgtactgtgccagtgaggaaagaccgaactgcacgcttttcgccgtaacatcgatatcttcttcgcggttataacgaatcgcccgacgcagcagcgcctgcgtttcatcgtcgtctgccggaacatcatgatggcggtacagccattcgcttaccgcttcacgcgttggcgcgcaaagcattgaaggcagcagcgtgctgtcgttttccattttcagtaattgcggcttaccgtcgcgcatgaccgccactgaacagtttgctgtaccgtaatcaaaaccaataaacacgaaataatccccatgccggtgaagaaggggcgtgactttagcgaaatgttgccgtcgcgacaaccggaatatgaaagcaaagcgtagcgtctgaataacgtttatgctgaaagcggattaacaaggagatgcgatgtataccctgaactggcagccgccgtatgactggtcgtggatgttgggatttctcgccgcccgtgcggtgaacggtgtggaaacggtcgctgacgattattatgcccgtagtctggcggtgggcgaatatcgcggcgtggtgactgctattccggatatagcccgccatactctgcacataaatttaagtgcaggtttagaacctgttgccgcagagtgtctggcgaaaatgagccgcctgtttgatctgcaatgtaacccgcagattgttaacggtgcgttgggcaagttaggcgcggcgcggcccggattgcgtttacctggttgtgttgatgcttttgagcagggcgtgcgggcgattttaggccaactggtgagcgtggcgatggcggcaaaattgaccgccagagtggcacagctttatggcgaacggctggatgattttccggattatgtctgcttccccacgcctcagcggctggcagcagccgacccgcaggcattaaaagcgttaggtatgccgttgaaacgggcagaggcgctgattaatctggcaaatgcggcgctggagggcaccttaccaatgacaattccgggcgacgtagagcaagcgatgaaaacgctgcaaacttttccgggtatcgggcgctggacggcgaattatttcgccttacgtggctggcaggcgaaagatgttttcctgccggatgattatctgattaaacagcgatttccgggaatgacaccggcacaaatccgccgttatgccgaacgctggaagccctggcgttcttatgcgctgttgcatatctggtatacggaaggctggcaaccagacggaacggacgaattgtaggcctgatacgccgcatcaggcgatggggaagcacgcctcagttaatcgcgaaataactgctattcaccagcaaatccagcggttgggcatcggcaatcacatcgccataaatcagatcgacgccgatgccagaaagcgtatccatcaccaggggtaaaactactggcccggcgatggtcttcatcccgagccgctgagcgtgcccctgaatgatcgtaatcagcatctcatccatcaaatttccctgcacgttggcgcataactcaccatcaagtagcaggtaatctgccatattcgctttcagcgagttgaagatttgcagatcgcggcccacctgactgaatacgatccgacatcccgccagccgcagtttttgcacgctttctgcgtgatctaaaatcgcgtctgccggaataatcagatgtaataaccgtggtggtagagggctattttccagctgctcaattagttcattcaccagcgtggcgctactcaaaccggcaacggaaagcgggagggcgatgcttatacctttactggcaaccgctttggcggcctgctggaaaaaatcgtggaatacccgtcggtcaagagcatggctaagtgccggatcgctgaagctacgacgaaatgtttgttcatcaataatctcgccttcgcaactccagagcttaagtgaaatcagccacaaattacgcgcttgcgggatccgcggcgaagcgacaccgtgggcgatcatcatcaactgattctctttaatcatccgccactgttcatcaagcgacatcgccgcccgttcgctatgtgcggcagcttgctgcggttcgtaaatcgtcacccggccccggccaccatttttggaggcataacaggcgatatcagcctgcgacatcacttcagccgcctgatgattgttgtcatcaatcaaggtaatcccggcactggcacctacccgatgtacacgtccttcccagataaagtgatagtcattcacggcgctgataatgcgtgtagcgataaaacgcgcactttcgacattacaatctggcagcagcagaccaaattcatcgccaccgagtcgcgccagcacgtcgctggagcgcagcatactcagcatcaatgacgccagttcgcgcagtaaagcgtcgccagcggcgtgcccggcgctgtcattcaccgctttaaagcgatcaagatcgataaacaccagtgcatgtcgctgatgtgtactgtttaccgtttgcagcaggatgcgtagttgcttctcaaaactggcgcgattggcgagatgcgtcagtgcatcatgggaggcgctgtagctcagctggcgcagcattttgcgcgattcggtgacgtcctgaatcaccagaaccgaaccaatattgctgccgtccagagtacttaacggcgtaatactgtaatgcacgtcgtagctgccgccgcttcggcagtgcaacaccacatcttgttcaatcgcggaacgtgaggtgtcggcactgtaaatgttctccattaatggtccgttgtcgccaaaagtaatatgcaacaccgtcaggagtggaacacctaacgcttcttcctgcgtccagccgctcatcttctccgccaccggattcataaaggtaattttcattgccatatcaatacagaccacggcttcgccgatggaatccagcgtaatgtgcaggcgctctttttcctgaaacaatgcctcgttaagctgttttacctcggtcatatccatattaatgccgagcaggcgttcgacttcgccttctttattcagtacccggttagcgagggcgcggatatggcgaatgccgtctttcacggtaatgcgaaattccagtttaaagggagagcgtgattgcaacgaatcacgaatcactttttcggcatgctggcgatcttccggcagcacgcactcgtaccacacctgccagttcggtttgatatgcggaggaatttcatacagctcgaacatccgcttatcccagctaaaaatattcggcttaagctcccactcccagatgccaatcccgcccgcttcgttagccagcgtgatgcgctccatcagttgctgattcacctgttcggtgcgttttagctcgttaatgtcttcaatctgagcgataaaatagagcggcgtgccatccgtgtggcgcaccagtgagacggcaagcaacgcccagacaacatcgccattgcggttgtagtagcgtttttccattgaataggtgtttatttcaccgctgatcagcttttcaacctgttgcagatctttattgagatcctccggccaggtcagttgctgaaaggtgagtccgcgcagctcttcctgactgtaaccgagaaactggcagagtgctttgttggattgcagccattgtccctcggtgcccactaacgccataccgatagcggaatattccatcgcgttccgaaagcgggtttcgctttcggaaatgtgtttgcgttccgcacgaaaggcatacatcaccatggtcatgatgttggcgggcagcaggatcagcaaaaacggtagccacggcatatggctcatcaggtatgtacgcggcgtagcaagcagggagggatccgcggccatcatcagtgacaccatcatcaccgtggtaaggaagatcaaaaaggcttccattcgtggcaggcgcacggcgctccacatcaacagcacaataatgaaagtaaaaggccacggcagatacagcatcgaaagccagcttaacgtcagtgtgatggctaacgtgagcagcgactcaaaaagcaaccgtgggttgcgatggcgcagcagatagtgtggtttaaataacaaccccagcggcaccagtgccagtgcgccgatggattctgacagtacccatatcaaaaatgccctgagaggatcgtctccgggcgtcagcaggataaccagaacaccccccaacagaggcggaacaatggcgctgccgagtgccagacgcagccagtcagccagattttgcaatgggttataccacggcagcaatttacgcagtagcactgccccgaccacggcttcaacaatattgatggtcgtccaggtcatgttcagcgagctggtggaaaaaagcaggatggatgcggcgatatttcccagtgagcagctcagcgcaatccccggccacatacgcccggcatggcgataaaacgccaccatcatgatggacgtcgggaaccacagtggggcgagttgggtgccaaactgcgaaagctcaagcgagaaaagggtaaagataaacgagactaaacctaaactgaccaggtgaagcagcgggtggggcagggcaattaatacatgctgtgattgtttgctcattaccgctttatccgcaagaccaggtcgccagtattcgtttctgtgtttatgctagtacaaaagttttacattttatatgcgaattgctcataaagtgacgtaaaggcggataatttgcgcaacttcgtataacaatttttaccttgcattaaaactgaacaacgtaatttgccaccgggaattattcgtcaacaattactctgagcgcgcggcaacgctattcgactggtatcaggcggatgaaatccctataattgccgcgtttggcgcttcgtcgcccccttcctaacatccaggttaatcaggtcgctaaatatatgactgatcagtctcatcagtgcgtcattatcggtatcgctggcgcatcggcttccggcaagagtcttattgccagtaccctttatcgtgaattacgtgagcaagtcggtgatgaacacatcggcgtaattcccgaagactgctattacaaagatcaaagccatctgtcgatggaagaacgcgttaagaccaactacgaccatcccagcgcgatggatcacagcctgttgcttgagcatttacaagcgttgaaacgcggctcggccattgacctgccggtttacagctatgttgaacatacgcgtatgaaagaaacggtgacggttgagccgaagaaagtcatcattctcgaaggcattttgctgctaacggatgcgcgtttgcgtgacgaacttaacttctcaattttcgttgataccccgctggatatctgcctgatgcgccgcatcaagcgtgacgttaacgagcgtgggcgttcaatggattcagtgatggcgcaatatcaaaaaaccgtgcgtccgatgttcctgcaattcattgagccttctaaacaatatgcggacattatcgtgccgcgcggcgggaaaaaccgcatcgccatcgatatattgaaagcgaaaataagtcagttctttgaataagcttgataaattgtgtaccgttcagtgataacctggtatgcccttgacgtaattggcgttaagggagtgatgcacgaaaggagaaaatgccatgcgtctgtgtgaccgagatattgaagcctggcttgatgaaggccgtttgtcgatcaacccacgtccgccagtggagcgtattaatggcgcgacggtggatgtgcgcctgggcaataaatttcgtaccttccgtggtcacacggcagcgtttatcgatctgagcggtcccaaagatgaagtgagcgccgcgcttgaccgcgtgatgagcgatgagatcgtactcgatgaaagcgaggcgttttatcttcacccaggagagctggcgctggcggtgacgctggagtcggtgacgctgccagccgatctggtgggctggctggacggtcgttcctcactggcgcgtctggggcttatggtgcacgtcaccgcgcaccgtatcgatccgggctggtctggctgtattgtgctggagttctacaactccggtaagctgccgctggcgctgcgtccgggcatgttaattggtgcgctgagctttgagccgctttccggcccggcggcgcgaccttacaaccgccgtgaagatgcgaaatatcgcaaccagcagggcgcggtagccagccgaatcgataaagactaattcaggcccattgaggataccatgagacgatttctgacgacgctgatgatactcctggtcgtgctggtggccgggttatctgcgttagtgttgctggtgaatccgaatgatttccgcgactatatggtcaagcaagttgctgcacgtagcggttatcaattgcagctcgacgggccactgcgttggcacgtctggccgcaacttagtatcctctccgggcgaatgtctctcactgcccagggcgcgagccagccactggttcgcgcagacaacatgcgtctggacgtggcgcttttaccactgctgagtcatcaactgagcgttaagcaggtgatgctaaaaggggcagtgatccaactgacgccgcagacggaagcggtacgcagtgaagatgccccggttgcaccacgcgacaataccttgccggatctgtcagacgatcgcggatggtcgtttgatatatccagtcttaaggtggcggacagcgtgctggtgttccagcatgaagatgacgagcaggtgacaatccgcaatattcgcctgcaaatggaacaagatccccaacatcgtggttcatttgagttctccgggcgggttaatcgcgatcagcgcgatctcacgatatcccttaacggtacggtagatgcttctgattatccgcatgatttaacggcggctattgaacaagttaactggcagttgcagggtgcagatttaccaaaacaaggtattcaggggcaggggagtttccaggcccagtggcaggagtcacataaacgcctttcatttaaccaaattagtttgaccgccaatgacagtacgctgagcgggcaagcacaggtcacgttgacagagaaaccggaatggcagctgagactgcaattcccgcaactgaatcttgacaacctcatcccgcttaatgaaacagcgaacggtgaaaacggtgccgcgcagcaggggcagagccaatcaacgttgccgcgcccggtcatttcttcgcgtattgatgaaccggcctatcagggactgcaaggctttacggctgatattttgttgcaggccagtaacgtgcgctggcgcggaatgaattttacagatgttgccacgcaaatgaccaacaagtcgggtttgctggaaattactcaactgcagggcaaacttaacggtggacaggtttcactgccgggcacgctggacgcgacatcaataaatccgcggataaacttccagccacggctggaaaacgttgagattggtaccattctgaaggcgtttaactatccgatttcgttgaccggaaagatgtcactggctggtgatttctccggtgctgacatagatgccgacgcattccgccataactggcaaggacaggcacatgtcgaaatgaccgacacgcgcatggaagggatgaacttccagcagatgattcagcaagcggtagaacgtaatggtggtgatgtgaaggccgctgaaaacttcgataacgtaacgcgtcttgaccgctttaccaccgatttgacgttgaaggatggcgtcgtgacgttaaacgacatgcaaggtcaatcgcccatgctggcgctttccggggctggtacgttgaatctggcggagcaaacctgtgacacccagtttgatattcgggtcgtggggggctggaacggggaaagcaaactgattgatttcctcaaagaaacgccagtaccgctgcgggtttatggcaactggcagcaacttaattacagcctgcaagtggaccagctgctacgcaaacatctacaggacgaagcgaaacgtcgcctgaatgactgggccgagcggaataaagattcccgcaatggcaaagatgtgaagaagttgctggagaagatgtaagacaagttatgcagatggcggcgtcaatttgtcgccatctgtatttatagcactaagcagcatgtggatattgaacttcaatacgttgaatatgcaaccctgcatgagccatcatggtgatcaatttatcgatactaaagatctggattttacctctggcaagttcagatatgcgaggttgagtgacccctaaagcagacgctgcctgagcctggctaaacccttgttgttcaatccagttattaatgatcgtaacaagttcggcacggatccgcatattttccgcttgttcaggggtgtcactcaccgcatcccacacactatcaaaggtttcaattttcatttttccgctcctgaacaagttctttatagcgtcgtttggctaaatcaatatccgattgactggtagtctgtgttttcttttgaaaacaatgcaatacgtaaaccgcttcttcaaattttgcgacatacatgacgcgatagatcccatcagcatcgcgagtacgaatctctcgcacaccagggccgatagttgaaaaaggtttccagtcgtatgggtttaacccttgttggatcctgtcgagttgatagccaatttcctgtcgagacgattctggaaatgcgcgtaaatcgtcaagactggtatcaagaaaagccagcttttttctcattactccatccttagattatactaaattttgtataaatcaaatgcgcagtttgaacctgcgcatttgatgttttatcacacctcgtactccatctcgccatccttacgcagcggaataatctgcaccttctgcacgcgatggctttccacctgcaacgttttgagcaagtaatcccctacctgaacttcttcgccaggttttggaatacgctgcaaatattccatcaacagcccggcaatggtgtgatattcgcgtttctcatccagcggtagcggcacatattgcaccagatcttccagcggcatatgaccattcgcagtccaggaaccgtcggcattcttctgaatatcatggcgggcgtcgatctcttccacttcgttcggcaagttaccggcaatggtttcagtgacgtcacttaatgtcacaatcccttccaccgagccaaactcatccaccacaaaagcaaagtgtgtgcgggcattacggaactgctccagggcaggtaacaacggcaaggtttccgggaacaccagcggctggcgaatcaacacccgcaggttgagcggttcgccgcgcagagactgttgtagcaggtcgataacgtgaacaacaccgagcaaatcttctgcgtcatcaccgtcggtaaccaccagccgcgtatgctgatttcgctccagcaactggcggatttcctcttccggcgcgttgagatcgatatgctcaatatcgtggcgcgacgtcataatgctgctgacagtacgctggttaagattaaggacccgctcaatcatccgccgttcctgcggattaaagatctgctggttaccatgatccaccagcatggacgcggtttcggcgtccagttccgcatcttctttttgcccgctaagcaggcgcattaccgcttcggtagtccgctggcgcagcgtctggttagcggaaagaaaacgtcgccggttaaagatagccaactgattgagcgcctcgatcatcaccgagaaaccaatagcagcgtacaggtagcctttcggaatgacgaagccgaaaccttctgccaccaggctaaagccaatcatcaacaggaagcttaagcagagaataacgatcgtcgggtgactgttaacaaattgcgttaacggcttgctggccatcaacatcaggctgatagcgataacaacggcggccatcatgaccagtaaatggtcgaccatcccgacggcggtaatcaccgagtcgagtgagaagatggcgtccagtaccacaatttgtgtcaccaccccccagaacttcgcacctttgcgttgcgtggggttattgctgtctttcccctccagccgttcgttcagctccatcgtggctttgaacagcagaaagaaaccaccaaacagcatgattaagtcgcgggcgctaaaggtaaacgagcggaagctgaacagcggttgagtcagggtgaccagccaggagatagacgccagcagtaacaggcgcattaacatcgccagcagcagcccggtaacccgtgcgcggtcgcgctgcttcggcggtagtttttcggcgaggatggcaataaagaccaggttatcaatgccgaggaccagttcgatcacaatcagcgtgattaacccggcccagatagacggatcggcaatccattccatagtaagtacaaaacctattcgttgtatgacaaatgtcacaattcgatcatggataaatcggggcaaaaatgcaatgttgcagcactatttatctcatattatttgaggtttataacctcacattatccctgaattaaaagtggtaataataaaacattatttaagaaatatcgcatgtggagacactatattaaatattgtcaacctaaagaaactcctaaaaaccatattgaatgacacttaatataattcttaaaaatagccaattgccgaattgttaccttgcctgctattccgttagctgtaacacttcctcctgcattattggagagccaatattcaattaccataatgtcaccttatattcggaagttaatttccgcaataaccctttctcatcaacgactgtatgttgagagggttttaaaaattaagctaaatcagtgtattggtagctaaaaagccaggggcggtagcgtgtctggatgcctgaaagaccagtctgaattattctgtcaatagcctgcggatgaaatcaatttttttaggactgatgccagttaaatttttattcaattaactgcaaggtaaatgtgcatggcgacattgctattaatagtgcacaggataattactctgccaaagtgataaataaacaatgatgaaatccaaaatgaaattgatgccattattggtgtcagtaaccttgataagcggttgcacagtacttccgggcagcaatatgtcgacgatgggtaaagacgtcatcaaacagcaggacgctgatttcgatctcgacaaaatggtgaatgtttatccgttgaccccgcgcctgattgaccaattacgcccacgcccgaatgtagcgcgccccaatatgacgctggaaagtgagatcgcgaattatcagtatcgcgtcgggccgggggacgttcttaatgtcaccgtctgggatcacccggaactcaccacgccagccggtcagtaccgcagctccagcgacaccggcaactgggtacagcctgacggcactatgttttacccgtatatcggcaaggttcacgtcgtggggaaaacgctcgctgaaatccgcagtgatattaccgggcgcttagcgacgtacatcgctgacccgcaggtggacgttaatatcgccgccttccgctcgcaaaaagcttatatctccggtcaggtgaataaatccggtcaacaggccatcaccaacgtgccactgaccattcttgatgccatcaacgccgcaggtggcctgaccgacaccgctgactggcgcaacgtggtgctaacacacaatggtcgtgaagagcgcatttctttacaggcgctgatgcaaaacggcgacctcaatcagaaccgactgctttaccccggcgatattctctacgtgccgcgtaatgatgatctgaaagtgtttgtgatgggtgaagtgaagaaacagagcaccctgaaaatggactttagcggcatgaccctgactgaagccctgggtaatgctgaaggcatcgacatgaccacctccaacgccagcggcatctttgtcattcgtccgctgaaaggcgagggtgggcgtaacggcaagattgccaatatctaccagctggatatgtccgatgccacgtcgctggtgatggcgacagaattccgcctgcaaccttatgacgtggtgtatgtcactaccgccccggtttcccgctggaaccgtctgatcaatcagttgctgccaactattagcggtgtccgttacatgacggatacagccagcgacattcataactggtaatcgtcatgtttaacaacatcttagttgtctgcgtcggcaatatttgccgttccccgacggcggaacgcttactgcaacgttatcacccggagctaaaagtggagtccgctggactcggcgcgctggtcggtaagggcgctgaccctaccgctatcagcatcgccgcagaacatcaactgtctctggaaggtcactgtgcccgtcaaatcagccgcagcctgtgtcgcaactacgacctgattttgaccatggaaaagcgccatatcgaacgcttatgcgagatggcacctgagatgcgcggcaaagtgatgctgtttggtcactgggataacgaatgtgaaatccccgatccatatcgcaaaagccgggaaacgtttgcagcggtgtacacattacttgaacggtctgcccgccagtgggcgcaggcattgaacgcagagcaggtataagaatgacagaaaaagtaaaacaacatgccgctccggtaacgggcagtgatgaaatcgatattggtcgcctggtcggcaccgtcattgaagcgcgctggtgggtgattggcatcaccgccgtatttgccctctgtgccgtggtttacaccttcttcgccacgccgatttatagtgccgacgcactggtacaaatcgagcaaaacagcggcaattcgttagtgcaggacattggttcggcattagccaacaaaccgccagcatcggacgccgagatccagttgattcgttcgcgtctggtgcttggtaaaacggtggacgatctcgacctcgatattgcggtgagcaaaaacacgttcccgattttcggtgcgggctgggatcgcctgatgggacgccagaacgagacggtaaaagtgaccacctttaaccgcccgaaagagatggcggaacaggtgtttacgcttaatgtgctggacgataaaaactacactctgagcagcgatggcggctttagcgcccgtgggcaagcgggccagatgctgaaaaaagaaggcgtcacgctgatggttgaagccattcacgcccgcccgggtagtgagtttaccgtcaccaaatactccacgctggggatgatcaatcaactacaaaacagcctgacggtaacggagaacggcaaagacgcaggcgtactgagcctgacttataccggtgaagatcgcgaacagatccgcgacattcttaacagcatcgctcgtaactatcaggaacaaaatattgagcgcaaatcggcggaagcgtcgaaaagcctcgctttcctcgcgcaacagttaccggaagtacgtagccgccttgatgttgccgaaaacaaactgaatgccttccgtcaggataaagattctgttgatctgccgctggaagcgaaagcggtgctcgattcgatggtgaacatcgacgcgcagttgaacgaactgacctttaaagaagcggaaatctccaagctgtacaccaaagttcatccggcgtatcgcacgctgctggagaaacggcaggcgctggaagacgaaaaagccaaacttaatggtcgcgtaacggcgatgccgaaaacccagcaggaaattgtccgtctgacccgcgatgtcgagtctgggcagcaggtctatatgcaactgctgaataaagaacaggagctgaaaatcaccgaagccagcaccgtcggcgatgtgcgcattgttgacccggcaatcacccagccaggtgtgctgaaaccgaagaaagggctgattatcctcggcgcaattatcctcggcctgatgctctctatcgtgggtgtactgctgcgctcgttgtttaatcgcggcatcgaaagcccgcaagtgctggaagaacacggtatcagcgtatatgccagcatcccgctgtcggagtggcaaaaagcgcgcgatagcgtcaaaaccatcaaaggggttaaacgctataaacagagccagctactggcggtggggaatccaaccgatctggcgattgaagccatccgcagtctgcgtaccagtctgcacttcgcgatgatgcaggcgcagaacaatgtgttgatgatgaccggggttagcccgtcaatcggtaaaacctttgtctgcgctaacctggcggcggtgatcagccagaccaataaacgggtgttgttgatcgactgcgatatgcgcaaaggctacacccacgaactgttgggcactaataacgttaatggcctgtcggaaattctgattggtcagggcgatgttactaccgctgctaaaccgacctctattgccaaatttgacctgatcccgcgcggtcaggtaccgccaaatccttctgaactgttgatgagcgaacgctttgccgaactggtgagctgggcgagtaaaaactacgacctggtgttgattgatacgccgccgattctggcagtgaccgatgcggcaattgtcgggcgtcatgttggaaccacgttaatggtggcgcgttatgcggtcaacacattgaaagaagtggaaaccagtctgagccgctttgagcaaaacggtattccggtgaaaggggtgattctgaactccatcttccgccgcgccagcgcgtatcaggattatggctattacgaatacgaatataagtcggatgcgaaataacgacgcctgcattcgcaccgccccgtaggccggataaggcgctcatgccgcatccggcaagcaaaccagctcataagtagggagaacaacctatgaaagacaatccgctgatctcaatctatatgccgacctggaaccgccaacaactggcgattcgggcgataaaatcggtcctgcgccaggactacaacaactgggagatgatcatcgtggatgattgctccacctcctgggaacaactccaacagtacgtcaccgccctcaacgatccgcgtatcacttacattcacaacgacattaacagcggggcgtgcgcggtacgtaaccaggcgattatgctggcgcaaggggaatatatcaccgggatcgatgatgatgatgaatggacccccaaccgtctgagcgtcttcctcgcccataaacagcaactggtcacacacgcctttttgtacgctaacgactacgtttgccagggcgaagtctattcccaaccggcaagtttgccactgtatcccaaatcgccgtattcacgccgcctgttctacaaacgcaatatcattggcaatcaggtctttacctgggcgtggcgtttcaaagagtgtttgttcgataccgaactgaaagcggcacaggattacgacattttcctgcggatggtggtggagtatggcgaaccgtggaaagtggaagaggcgacgcagatcctgcatatcaatcacggtgaaatgcagatcacctcgtcaccgaaaaaattctccggatacttccacttttaccgcaagcacaaagacaaattcgaccgtgcaagcaaaaaatatcagctgtttaccctctaccagatccgcaataaacgtatgacctggcgcactttgctgacgctgctgtcggtgcgtaacggcaaacgtctggctgatggtattcgggggcgctaaagatgctggaagatctgcgcgccaacagctggagtttacgcccgtgctgcatggttcttgcctatcgcgttgctcatttttgttcggtgtggcgcaaaaagaacgtcctcaacaatctgtgggcggccccgctgctggtgctgtatcgcattatcaccgaatgctttttcggttatgaaatccaggctgccgcgaccattggccgccgctttactatccatcacggttacgccgtagtgatcaataaaaacgtggtagcgggggatgatttcaccattcgccacggcgtcactatcggcaatcgtggtgccgataacatggcatgtccacacattggcaacggcgtcgaactcggtgccaacgtcattattcttggtgatatcacgcttggtaacaacgtcaccgtgggcgcgggcagcgtggtgctcgactctgtcccggacaacgcgctggtggtgggagaaaaagcgcgagtgaaggtaattaaatgaatattctgcaatttaatgtgcgactggcggaaggcggggcggcaggtgtggcgttagatctccaccagcgtgcgctgcaacaggggctggcgtcacattttgtctacggctacggcaaaggcggcaaagagagcgtcagccatcagaactatccgcaggtcatcaaacatacgccgcggatgaccgcgatggcgaacattgccctgtttcgtctgtttaatcgcgatctgttcggcaatttcaatgagttatatcgcaccattactcgcacaccgggtccggtggtcctgcattttcatgtgctgcacagctactggttgaatcttaagagcgtggtgcgcttttgcgaaaaagtgaaaaaccacaaaccggatatcactttggtctggacgttacacgatcactggagcgttaccggacgctgcgcctttaccgacggttgtgaaggctggaaaaagggctgccagaaatgcccgaccttaaataattatccgccggtgaagattgatcgcgcacaccagctggtggcgggcaaacgccagttattccgtgagatgctggcgctgggctgtcagtttatttcccccagccagcatgtggctgatgctttcaatagtctgtacggtccagggcgttgccggattatcaataatggcattgatatggcaaccgaagcgattctggcggacttgcctccggtgcgcgaaacccagggcaagccgaaaatcgcggtggtggcgcatgatctgcgttacgacggcaaaactaaccagcaactggtacgcgagatgatggcgctgggcgacaaaatcgaactgcatacctttggtaagttctcgccgttcaccgctggcaacgtggttaatcacggctttgaaactgacaagcgcaagttgatgagcgcgctcaatcagatggatgcgctggtattcagttctcgcgtcgataactacccgctgattttgtgtgaggcgctatcgattggcgtgccggtgattgccacccatagcgacgcggcgcgggaagtgttgcaaaaatccggcggtaaaaccgtcagcgaagaagacgtgctgcaactggtgcagttaagcaaaccggaaatcgcgcaggcgatatttagtaccacgctggctgagttcagccaacgcagccgcgccgcctacagtggacaacagatgctggaggagtatgtcaacttctatcagaatctgtagctacctgctgctgccgctgatttacctgttggttaacgtcaaaatcgcccagcttggcgaaagtttccccatcaccatcgtcacttttttacctgtcttgttactgctgtttttagaacgcatcagcgttaaaaaattgatgattgccttagggattggcgcgggactcacggcgtttaactacctgtttggtcagtcgttggatgccagtaaatacgtcacttcaaccatgctgtttgtctatattgtgatcattattggcatggtgtggagtattcgctttaaaacgatttcgccccacaaccaccgcaagatattacgctttttttatctggtggtcgggttggtggtggcgctggcggcggtggagatggcgcaaattatcctcaccggtggcagcagtattatggagtcgatttcgaaatatctgatttacagcaacagctatgtgctgaatttcatcaaattcggcggcaagcgcacgacagcactttatttcgaaccggcatttttcgctctggcattaatctcaatttggctcagcatcaaacagtttggtatcaaaacccctaaaaccgatgctatgattctcgcagggataatattatccggatcgttttcaggggttatgacctttatcctgttttatttgctggagtgggcatttcaatatctgaataaagaggcgattaagaaaaagttaccgttagcattgatttctctggctgtattcctggttggtgtggtaattgcatttccttatatttccacccgtctgggcgatttaggtacggaaggatcgtcatcgtattatcgtattgtcggtccgctggtgatggtcggttattctttgacccatattgacggtgtagtcagatttggctcactttatgaatatgtcgcatcattcggaatatttaacggtgcggatgtcggaaaaaccatagacaatggtttgtatctgctgattatttatttttcctggttcgcggtgtttttatcgctgtggtacatggggaaagtgataaaaatgatgatcaacgcttttggtgataatcgcaattttcgcgtgcaattatatcttttcactccggtatcgctgttttttaccggttcgatatttagcccggaatatgcatttttaatcgtctgtccgtttattttgcgaaaagcgttaaatattacgaggtaagaataagaacatgttgcttagcataatcactgtcgcgtttcgtaacctcgaagggatagtcaaaacacatgcctcgctggcgcatctggcgcaggcggacgatatcagcttcgaatggattgttgtcgatggcggttccaatgacggcacccgtgagtacctggaaaatctcaatggtatctataacctacgctttgtcagcgaaccagataacggtatctacgacgccatgaacaagggcattgcgatggcacaaggcaagttcgcgctgtttctcaactcgggcgatatttttcatcaggatgccgcaaattttatccgtaagttaaaagtgcaaaaagataacgtgatgatcaccggcgatgcgctgctggattttggcgacgggcataaaattaaacgtagcgccaaaccgggctggtatatttatcacagcctacccgccagtcatcaggcgatatttttcccggtatccggcttgaagaaatggcgttatgacctggaatataaagtttcttccgattacgcgctggcggccaaaatgtatagagccggttatgcatttaaaaaactcaatggcctggtgtctgaattttctatgggtggggtatcaaccaccaataatatggaattgtgtgctgacgccaaaaaagtccaacggcaaatattacatgtgcctggcttctgggcagaattatcctggcatttacgccagcgtactacctcaaagacgaaagccttatataacaaaagctgaatataagggaaaacgatgcaagatttaagcggtttctcggtaccgaaagggttccggggcagcaatgctattaaagtgcaattgtggtgggcggtacaggcaacaatatttgcctggtcgccacaagtattgtatcgctggcgggcttttttattacgtttattcggcgcaaaaataggaaaaaacgtagttattcgtccgtcagtaaaaattacctatccgtggaaattaaccttaggtgattacgcgtgggtcggcgatgaggtcaatttatataccctcggtgaaataaccattggcgcacattcggtgatatcgcagaaaagttatttatgcaccgggagccacgaccatgcaagtcaacatttcaccattaacgccacgcctattgtgattggcgagaaatgctggctggcaaccgatgtttttgttgccccaggcgtcacgatcggcaacggcaccgtcgtgggtgcgcgaagcagtgtttttaaatcgcttccggcaaatgtggtttgccgggggaatcccgcagtggtgatacgcgaacgcgttgaaactgaataaattcaaaaaatacagaggaataagacatgtcaaaagtcgctctcatcaccggtgtaaccggacaagacggttcttacctggcagagtttctgctggaaaaaggttacgaggtgcatggtattaagcgtcgcgcatcgtcattcaacaccgagcgcgtggatcacatttatcaggatccgcacacctgcaacccgaaattccatctgcattatggcgacctgagtgatacctccaacctgacgcgcattttgcgtgaagtacagccggatgaagtgtacaacctgggggcaatgagccacgttgcggtttcttttgagtcaccggaatataccgcagacgtcgatgcgatgggtacgctgcgcctgctcgaggcgatccgcttcctcggtctggaaaagaaaacccgtttttatcaggcttccacctctgaactgtatggtctggtgcaggaaattccgcagaaagagaccacgccgttctatccacgctctccgtatgcggtcgccaaactgtatgcctactggatcaccgttaactaccgcgaatcctacggcatgtatgcctgtaacggtattctcttcaaccatgaatccccgcgccgcggcgaaaccttcgttacccgcaaaatcacccgcgcaatcgccaacatcgcccaggggctggagtcgtgcctgtacctcggcaatatggattccctgcgtgactggggccatgccaaagactacgtaaaaatgcagtggatgatgctgcaacaggaacagccggaagatttcgtaattgctaccggcgttcagtactccgtgcgtcagttcgtagaaatggcggcggcacagttgggtatcaaactgcgctttgaaggcacgggcgttgaagagaagggcattgtggtttccgtcaccgggcatgatgcgccgggcgttaaaccgggcgatgtgattatcgccgttgacccgcgttacttccgcccggcagaagttgaaacgctgctcggcgacccgaccaaagcgcacgaaaaactgggctggaaaccggaaatcaccctcagagagatggtgtctgaaatggtggctaatgacctcgaagcggcgaaaaaacactctctgctgaaatctcacggctacgacgtggcgatcgcgctggagtcataaacatgcgtaaacaacgaatctttatcgctggccatcgtgggatggttggttccgccatcaggcgtcagctcgaacagcgcggtgatgtggaactggtattacgcacccgcgacgagctgaacctgctggacagccgcgccgtgcatgatttctttgccagcgaacgtattgaccaggtctatctggcggcggcgaaagtgggcggcattgttgccaacaacacctatccggcggatttcatctaccagaacatgatgattgagagcaatatcattcacgctgcgcatcagaacgacgtgaacaaactgctgtttctcggatcgtcctgcatctacccgaaactggcaaaacagccgatggcagaaagcgagttgttgcagggcacgctggagccgaccaacgaaccttatgccattgccaaaatcgccgggatcaaactgtgcgaatcttacaaccgccagtacggacgcgattaccgctcggtcatgccgaccaacctgtacgggccgcacgacaacttccatccgagtaactcgcatgtgatcccagcattgctgcgtcgcttccacgaggcgacggcacagaatgcgccggacgtggtggtgtggggcagcggtacaccgatgcgtgaatttctgcacgtcgatgatatggcggcggcgagcattcatgtgatggagctggcgcacgaagtctggctggaaaccacccagccgatgctgtcacacattaacgtcggcacgggcgttgactgcactatccgcgagctggcgcaaaccatcgccaaagtggtgggttacaaaggtcgggtggtttttgatgccagtaaaccggatggtacgccgcgcaaactgctggatgtgacgcgcctgcatcagcttggctggtatcacgaaatctcactggaagcggggcttgccagcacttaccagtggttccttgagaatcaagaccgctttcgggggtaatgatgtttttacgtcaggaagactttgccacggtagtgcgctccactccgcttgtctctctcgactttattgtcgagaacagtcgcggcgagtttctgcttggcaaaagaaccaaccgcccggcgcagggttactggtttgtgccgggagggcgcgtgcagaaagacgaaacgctggaagccgcatttgagcggctgacgatggcggaactggggctgcgtctgccgataacagcaggccagttttacggtgtctggcagcacttttatgacgataacttctccggcacggatttcaccactcactatgtggtgctcggttttcgcttcagagtagtggaagaagagctgttactgccggatgagcagcatgacgattaccgctggctgacgccggacgcactgctcgccagtgacaatgttcacgctaacagccgcgcctattttctcgctgagaagcgtgccggagtacccggattatgaaaatactggtctacggcattaactactcgccggagttaaccggcatcggcaaatacaccggcgagatggtggaatggctggcggcacaaggtcatgaggtgcgggtcattaccgcaccgccttactacccgcaatggcaggtgggtgagaactattccgcctggcgctacaaacgagaagagggggccgccacggtgtggcgctgcccgctgtacgtgccaaaacagccgagcaccctgaaacgcctgttgcatctcggcagttttgccgtcagcagttttttcccgttgatggcgcaacgtcgctggaagccggatcgcattatcggcgtggtgccaacgctgttttgcacgccgggaatgcgcctgctggcgaaactctctggtgcgcgtaccgtgctgcatattcaggattacgaagtagacgccatgctggggctgggccttgccggaaaaggcaaaggcggcaaagtggcacagctggcaacggcgttcgaacgtagcggactgcataacgtcgataacgtctccacgatttcgcgttcgatgatgaataaagccatcgaaaaaggcgtggcggcggataacgtcatcttcttccccaactggtcggaaattgcccgttttcggcatgttgcagacgccgatgttgatgcccttcgtaaccagcttggcctgccggataacaaaaaaatcattctttactccggcaatattggtgaaaagcaggggctggaaaacgttattgaagctgccgatcgtctgcgcgatgaaccgctgatttttgccattgtcgggcagggcggcggcaaagcgcggctggaaaaaatggcgcagcagcgtggactgcgcaacatgcaattcttcccgctgcaatcgtatgacgctttacccgcactgctgaagatgggcgattgccatctggtggtgcaaaaacgcggcgcggcagatgccgtattgccgtcgaaactgaccaatattctggcggtaggcggtaacgcggtgattaccgcagaggcccacacagaactggggcagctttgcgaaacctttccgggcattgcggtttgcgtagaaccggaatcggtcgaggcgctggtggcggggatccgtcaggcgctcctgctgcccaaacacaacacagtggcacgtgaatatgccgaacgcacactcgataaagagaacgtgttacgtcaatttataaatgatattcggggataattatggcgcagtcgaaactctatccaattgtgatggcaggtggctccggtagccgcttatggccgctttcccgcgtactttaccccaagcagtttttatgcctgaaaggcgatctcaccatgctgcaaaccaccatctgccgcctgaacggcgtggagtgcgaaagcccggtggtgatttgcaatgagcagcaccgctttattgtcgcggaacagctgcgtcaactgaacaaacttaccgagaacattattctcgaaccggcagggcgaaacacggcacctgccattgcgctggcggcgctggcggcaacacgtcatagcccggagagcgacccgttaatgctggtattggcggcggatcatgtgattgccgatgaagacgcgttccgtgccgccgtgcgtaatgccatgccatatgccgaagcgggcaagctggtgaccttcggcattgtgccggatctaccagaaaccggttatggctatattcgtcgcggtgaagtatctgcgggcgagcaggatacggtggcctttgaagtggcgcagtttgtcgaaaaaccgaatctggaaaccgcccaggcctatgtggcaagcggcgaatattactggaacagcggcatgttcctgttccgcgccggacgctatctcgaagaactgaaaaaatatcgcccggatattctcgacgcctgtgaaaaagcgatgagcgccgtcgatccggatctcgattttattcgcgtgaatgaagaagcgtttctggcctgcccggaagagtcggtggattacgcggtcatggaacgtacggcagatgccgttgtggtgccgatggatgcgggctggagcgatgtcggttcctggtcctctttatgggagattagcgcccacaccgccgagggcaacgtttgccacggcgatgtgattaatcacaaaactgaaaacagctatgtgtacgccgaatctggcctggtcaccaccgtcggggtgaaagatctggtagtggtgcagaccaaagatgcggtgctgattgctgaccgtaacgcggtgcaggatgtgaaaaaagtggtcgagcagatcaaagccgatggtcgccatgagcatcgggtacatcgcgaagtgtatcgtccgtggggcaaatatgactctatcgacgcgggcgaccgctaccaggtgaaacgcatcaccgtgaaaccgggcgagggcttgtcggtacagatgcaccatcaccgcgcggaacactgggtagtggtcgcgggaacggcaaaagtcaccattgatggtgatatcaaactgcttggtgaaaacgagtccatttatattccgctgggggcgacgcattgcctggaaaacccggggaaaattccgctcgatttaattgaagtgcgctccggctcttatctcgaggaggatgatgtggtgcgcttcgcggatcgctacgggcgggtgtaaacgtcgcatcaggcgcagtttgtcggatgcggcgtgaacgccttatccgacctacggttcgggtttgtaggcctgataagacgcggcagcgtcgcatcaggcaatgaatgcgaaaccgcgatgtaaataacgacaaaaacaaaattggccgtttcggtcagggccaactattgcctgaaaaagggtaacgacatgaaaaaattaacctgctttaaagcctatgatattcgcgggaaattaggcgaagaactgaatgaagatattgcctggcgtattgggcgtgcctatggcgaatttctcaaaccgaaaaccattgtgttaggcggtgatgtccgcctcaccagcgaaatcttaaaactggcgctggcaaaaggtttacaggatgcgggtgtcgatgtgctggatattggcatgtccggcaccgaagagatctattacgccacgttccatctcggcgtggatggcggcatcgaagtcactgccagccataatccgatggattacaacggcatgaagctggtacgcgaaggggctcgcccgatcagcggcgataccggactgcgcgacgtccagcgtctggcagaagccaatgacttccctcctgtcgatgaaaccaaacgcggtcgctatcagcaaatcaatctgcgtgatgcttacgttgatcacctgttcggttatatcaacgtcaaaaacctcacgccgctcaagctggtgattaactccgggaacggcgcagcgggtccggtagttgacgccattgaagcccgctttaaagccctcggcgcacctgtggaattgatcaaagtgcacaacacgccggacggcaatttccccaacggtattcctaacccgctgctgccggaatgccgcgacgacacccgcaatgaggtcatcaaacacggcgcggatatgggcattgcctttgatggcgattttgaccgctgcttcctgtttgacgaaaaagggcagtttatcgagggctactacattgtcggcctgctggcagaagcgttcctcgaaaaaaatcctggcgcgaagatcatccacgatccacgtctctcctggaacaccgttgatgtggtgactgctgctggcggcacgccggtaatgtcgaaaaccggacacgcctttattaaagaacgtatgcgcaaggaagacgccatctatggtggcgaaatgagcgctcaccattacttccgcgatttcgcttactgcgacagcggcatgatcccgtggctgctggtcgccgaactggtgtgcctgaaaggaaaaacgctgggcgaactggtgcgcgaccggatggcagcgtttccggcaagcggtgagatcaacagcaaactggcgcaccccgttgaggcgattaaccgcgtcgaacagcattttagccgcgaggcgctggcggtggatcgcaccgatggcatcagcatgacctttgccgactggcgctttaatctgcgctcctccaacaccgaaccggtggtgcggttgaatgtggaatcgcgcggtgatgtgccgctgatggaagcgcgaacgcgaactctgctggcgttgctgaacgagtaatgtcggatcttcccttaccccactgcgggtaaggggctaataacaggaacaacgatgacaaatctaaaaaagcgcgagcgagcgaaaaccaatgcatcgttaatctctatggtgcaacgcttttcagatatcaccatcatgtttgccggactatggctggtttgcgaagtgagcggcctgtcattcctctacatgcacctgttggtggcgctgattacgctggtggtgttccagatgctgggtggcatcaccgatttttatcgctcatggcgaggtgttcgggcagcgacagaatttgccctgctgctacaaaactggaccttaagcgtgattttcagcgccggactggtggcgttcaacaatgatttcgacacgcaactgaaaatctggctggcgtggtatgggctgaccagcatcggactggtggtttgccgttcatgtattcgcattggggcgggctggctgcgtaatcatggctataacaagcgtatggtcgccgtagcgggggatttagccgccggacaaatgctgatggagagcttccgtaatcagccgtggttagggtttgaagtggtgggcgtataccacgacccaaaaccgggcggcgtttctaacgactgggcgggcaatctgcaacagctggtagaggatgcaaaagcgggcaagattcataacgtctatatcgcgatgcagatgtgcgacggcgcgcgcgtgaaaaaactggtccatcaactggcggacaccacctgttcggtgctgctgatccccgatgtctttaccttcaacattctccattcccgtatcgaagagatgaacggcgtaccggtggtgccgctttacgacacaccgctttccggggttaaccgcctgctcaaacgtgcggaagacattgtgctggcgacgcttatcctgctgctgatctccccggtgctgtgttgcattgcgctggcggtgaaactcagttcacctgggccggttattttccgccagactcgctacggcatggacggcaaaccgatcaaagtgtggaagttccgttccatgaaagtgatggagaacgacaaagtggtgactcaggcgacgcagaacgatccgcgcgtcaccaaagtggggaattttctacgccgcacctcgctggatgaattgccgcagtttattaatgtgctgaccggggggatgtcgattgtcggtccgcgtccgcatgcggtggcgcataacgaacagtatcgccagctcattgaaggctacatgctgcgccataaggtgaaaccgggcattaccggctgggcgcagattaacggctggcgcggcgaaaccgacacgctggagaaaatggaaaaacgcgtcgagttcgaccttgagtacatccgcgaatggagcgtctggttcgatatcaaaatcgttttcctgacggtgttcaagggcttcgttaacaaagcggcatattgatatgagcttacgtgaaaaaaccatcagcggcgcgaagtggtcggcgattgccacggtgatcatcatcggcctcgggttggtgcagatgaccgtgctggcgcggattatcgacaaccaccagttcggcctgctgactgtgtcgctggtgatcatcgcgctggcagatacgctttctgacttcggtatcgctaactccattattcagcgaaaagaaatcagccaccttgaactcaccacgctgtactggctgaacgttgggctggggcttgtggtgtgcgtggcggtgtttttgttgagtgatctcattggtgacatgctgaataacccggacctggcacccttgattaaaacattgtcgctggcgtttgtggtgatcccccacgggcaacagttccgcgcgttgatgcagaaggagctggagttcaacaaaatcggcatgatcgaaaccagcgcggtgctggcgggcttcacttttacggtggttagcgcccatttctggccgctggcgatgaccgcgatcctcggttatctggtcaatagtgcggtaagaacgctgctgtttggctactttggccgcaaaatttatcgccccggtctgcatttctcgctggcgtcggtggcaccgaacttacgctttggtgcctggctgacggcggacagcatcatcaactatctcaacaccaacctttcaacgctggtgctggcgcgtattctcggcgcgagtgtggcaggggggtacaacctggcgtacaacgtggccgttgtgccgccgatgaaactgaaccccatcatcacccgcgtgttgtttccggcgtttgccaaaattcaggacgacaccgaaaagctgcgcgtcaacttctacaagctgctgtcggtggtggggattatcaactttccggcgctgctcgggctgatggtggtgtcaaataactttgtaccgctggtctttggtgagaagtggaacagcattattccggtgctgcaattgctgtgtgtggtggggctgctgcgctcagtggggaacccgattggttcgctgctgatggcgaaagcgcgggtcgatatcagctttaaattcaacgtattcaaaacctttctgtttattccggcgattgttattggtgggcagatggcgggcgcaatcggcgtcacgcttggcttcctgctggtgcagattatcaacaccattctgagctatttcgtgatgattaaaccggtgctcggttccagttatcgccagtacatcctgagtttatggctgccgttttatctctcgctgccgacgctggtggtcagttatgcgctgggcattgtgctgaaagggcaactggcgctggggatgctgctggcggtgcaaatagccgcaggcgtgctggcgtttgtagtgatgattgtgctgtcgcgccatccgctggtggtggaagtgaagcgtcagttttgtcgcagcgaaaaaatgaaaatgcttttacgggcggggtgagttgttgttttcggttccggcaatggttgccggatgcggcgtaaaacgccttatccgtcctacggttctgtgctcgggacctgtaggcctgataagacgcgtcagcgtcgcatcaggcactgaatgccggatgcggcgtgaacgccttatccggcctacggttctgtgctcgggtcttgtaggcctgataagacgcgccagcgtcgcatcaggcaaaaagctgcaacgaacaaaacaaacgcagcttcacctggcatcaaatttatgaggaaaaaatgaaattacttattctgggcaaccacacttgcggcaatcgtggcgacagcgccatcctgcgcggcttacttgatgccatcaacatcctcaatccacatgccgaagtggacgtgatgagccgctatccggtcagttcttcctggctgctcaaccgcccggtaatgggcgatccactgttcctgcaaatgaaacaacacaacagcgtggcgggcgttgtcgggcgcgttaaaaaagtcctccgtcgccgctaccagcatcaggtattgctctcacgcgtcaccgacactggcaagttgcgtaatatcgccatcgcccagggattcactgacttcgtgcgcctgctgtcaggttacgacgccattattcaggtcggcggatcgttttttgtcgatctctacggcgtgccacagtttgaacatgcgctttgcacatttatggcgaaaaagccgctgtttatgattggtcacagcgtcggccccttccaggatgagcaatttaaccaactggcgaactacgtttttggtcactgcgatgcgctgatcctgcgcgaatcggtcagccttgatttgatgaaacgcagcaatatctccactgcaaaagttgaacatggcgtcgataccgcgtggctggtcgatcaccacacagaagacttcaccgccagctatgccgttcaacactggctggacgttgccgcacaacagaaaacggtggcaattaccctgcgcgaactggcaccgttcgacaaacgtctcggcaccacccaacaagcgtatgaaaaagcctttgccggggtggtcaatcgcattctcgacgaaggctatcaggtcattgcgctctccacctgtacgggcatcgacagctataacaaagacgaccgcatggtggcgctcaatctgcgccagcacatctgcgatcctgcccgttaccacgtagtgatggatgaactcaatgatctggaaatgggcaaaattctcggtgccagtgaactcaccgtcggtacgcgcctgcactcagccattatctcgatgaactttgccactccggcgattgccatcaactatgaacataaatccgccgggattatgcagcagctggggctgccagagatggcaattgatatccgtcatttactggacggcagcctgcaagcgatggttgcggataccttaggccaacttccggcgctgaacgcgcgacttaacgaagccgtcagtcgcgaacgtcagacgggaatgcagatggtgcaatctgtgcttgaacgcatcggggaggtgaaatgaaggtcggcttctttttactgaaatttccgctgtcgtcggaaaccttcgttctcaaccaaatcactgcgtttattgatatgggatttgaggtggagattgtcgcgctgcaaaaaggcgacacacaaaacacccacgcggcatggacgaaatacaaccttgccgccagaacccgctggttacaggacgaacctacgggcaaagtggcgaagctgcgccaccgcgccagccagaccttacgcggcattcatcgcaaaaatacctggcaggcgctcaacctcaaacgctatggtgccgagtcgcggaacctgattttgtctgccatttgcggccaggtcgcaacaccattttatgccgatgtgttcatcgctcattttggcccggcgggggtaaccgcagcaaaactacgcgaattgggtgtcattcgcggcaaaattgccactatcttccacggtattgatatatccagtcgggaagtgctcaaccactacactcccgaatatcagcaactgttccgccgtggcgacctgatgctaccgataagtgatttgtgggccggaaggctgcaaaaaatgggctgcccgagggaaaaaattgccgtatcgcgtatgggcgtggacatgacgcgctttagcccgcgtccggtgaaagcacccgcaacgccgctggaaatcatttccgtcgcacgcttaaccgagaaaaaaggcctgcatgtggcgattgaagcctgccgtcagttgaaagagcagggcgtggcatttcgctatcgcattctcggcattggcccgtgggaacgacgcctgcgcaccctcatcgaacaatatcaactggaagatgtggtggagatgccgggctttaaaccgagccatgaagtgaaagcgatgctcgacgacgcggatgtcttcctcttgccatcggttacaggtgcggatggtgatatggaaggtattccggtggcgctaatggaagcaatggcggtcggcattccggttgtttcaactctgcatagcggaataccagaactggttgaggccgataaatccggctggctggtgcctgagaatgatgctcgcgcactggcgcaacgcctagcggcatttagccaactggacaccgacgaactggctccggttgtcaaacgagcgcgcgaaaaagtcgaacacgattttaaccagcaggtgattaatcgagaactcgccagcttgctgcaagctttatagaggagaacgtatgccatttaaaaaactctcccgacgcaccttcctgacggcaagctccgcgcttgccttcctccatacccctttcgctcgcgcacttcccgaccaacagagcgttaacattaacgactacaaccctcacgactggatcgcctcatttaaacaagccttcagcgaaggacaaacagtcgtcgtgcctgccggattcgtttgtgacaatatcaacaccggcatcttcatccctcccggcaaaacgttacacatccttggaagcctgcgcggcaacggcagagggcgatttgtcttacaggacggcagccaggtgacaggggaggagggcggcagtatgcataacatcaccctggatgtgcgtggttctgactgcaccatcaaagggctggcgatgagcggtttcggcccggtaacgcagatttatatcggcggcaaaaacaaacgggttatgcgtaacctgaccatcgataacctgaccattagccacgctaattacgccatcttacgtcagggatttcataaccagattatcggtgccaacatcaccaattgtaagttcagcgacttacagggggacgccattgaatggaacgtggcgattaacgacagtgatattttgatctccgaccacatcatcgagcgcatcaactgtaccaacggcaaaatcaactggggaatcggcataggccttgcggggagtacttatgataataactacccggaagaccaggcagtgaaaaactttgtcgtggcgaatatcacgggatcggattgtcgacaactgatccatgttgaaaatggtaaacattttgttattcgtaatatcaaagcccgcaatatcacgccggatttcagtaagaaagcaggtattgataacgccacggtcgctatttacggttgtgacaatttcgtgattgataatattgaaatgattaatagcgccgggatgttaatcggttatggggtaattaaaggcaaatatctctcgataccgcaaaatttccgagtgaataatattcagctggataacacccaccttgcttacaaattgcgcggtatccaaatctctgccgggaatgctgtctcctttgtggcactgactaacattgagatgaagcgtgcctcgttggagttacacaacaaaccgcaacatctttttatacgaaatatcaaagtgatgcaggaatcctctgttgcacccgcattgagcatgaacttcgacatgcgcaaagacgttcgcggcgtctttatggcgaaaaaagaaacactgctgtctcttgcaaatgttcatgcggtgaatgaaagagggcaaagctccgtcgatatcgacagggttaatcaccatattgttaatgtggaaaagattaactttagattgccagaacggagagagtagatttgcgaccattcctggaaaaatggagccatacttaggaacaatgctactgcaatccacaacgaagcggcgtaacatcacaagtaattcagtaatcaattcagggtaattgatgctggcgaaaaaaatcgaacaagctataattcagcaaccattttacaggtggatgaaataatgacgaatttaaaagcagttattcctgtagcgggtcttgggatgcatatgttgcctgccactaaggcgattcccaaagagatgctaccgatcgtcgacaagccaatgattcagtacattgttgacgagattgtggctgcagggatcaaagaaatcctcctggtaactcacgcgtccaagaacgcggtcgaaaaccacttcgacacctcttatgaattagaatctctccttgaacagcgcgtgaagcgtcaactactggcggaagtgcagtccatctgtccgccgggcgtgaccattatgaacgtgcgtcagggcgaacctttaggtttgggccactccattttatgtgcacgacctgccattggtgacaacccatttgtcgtggtactgccagacgttgttatcgatgacgccagcgccgatccgctacgctataaccttgctgccatgattgcgcgcttcaacgaaacgggccgcagccaggtgctggcaaaacgtatgccgggtgacctctctgaatactccgtcattcagaccaaagaaccactggatcgtgaaggtaaagtcagccgcatcgtcgaatttatcgaaaaaccggatcagccgcagacgctggactcagacatcatggccgttggtcgctatgtgctttctgccgatatttggccggaacttgaacgcacgcaacctggtgcatgggggcgtattcagctgactgatgctattgccgaactggcgaaaaaacagtccgttgatgccatgctgatgaccggcgacagctacgactgcggtaaaaaaatgggctatatgcaggcgtttgtgaagtatggactgcgcaacctgaaggaagggccaaagttccgtaagagcattgagaagttgctcggggaatagatcccaagccaatgtaacaataatttagataaatagcggcagctaacatcccggcgtctatgctttaaacaaaggaatgttactgtcgtttttctttttaaaacaaagaataacaacgagttaacctactaagtttaatctattttttgttggatttatccttgtttctgacagcatttggtaagacaattggcgtttgaatttaagatagctttgcgatagctagcggggcggggtacatctttggcattttgctagtgcactggtagctgttaagccaggggcggtagcgtggtaagattgtgtttatatgatgcgttctcaaaataagaaataataatcctgactatttttatactattgataatatctgaaataaacttaagagcaaacatgaaagtaattgtaaataatttttttgatggtattttgaaaagaggaataccgatctatacttctgaacttgtgcaaaagttaagagacaataatgttcaggttatttatgttgcatgtccaaaagcattccataagctgccttcatggtttctgaatgttctttttataatagtagagcagcttttaataccaattatgggtatattttatagaactaagtataatatatatccctataatagtagttccatcattgacttgttattaggtaaggcaattgttataattcatgacttcattagtcttaagaaaaataaacgaaatcttgctgccatttatgtgaaagtctgtatttatttttcatcttttttagcaaagaaagtaatatttatttctcaaagcactcagcgagtatctaagagaatatcgctatttaagtgtatagaatctatcctgctcccaaatccatttttctcatttgagaaaattgctaatgttaccgaaataaaagatcttggatatttacttctagtttcaggtttaggggataataaggatctaggcacagctctggactattatttttcaatcccaagggaagaaagaataccattaaaaatattaggttgtgggaatggtattagcaaggttaacgacttaattgatgggcgggatacagataaagaaattgaaattattggttttgtttctttagaggaagtcgtcaaactatattgtaattctaaaattgtttgggctcattcgcttgccgaggggtatggaaggactttagctgaagcaaaactcacatgcaaaaatgttatatgcacacggatctctgctttccgcgaacaaaaggattcgaatattttcttttatacttactattctgagtattatgaagtctattcatacttggtagataattcacccagtgtcgaaaggaaagctctgcatgaacatattttatttgaaaatgaattgagaaagatttatgagtaatattgatataaataagaaacagatattagttttgactccacggttcccgtttcctgtcattggtggggatcgattacgtatctataagatctgtaaagaactgtctaagcattatgatcttacgttgctgagtctgtgtgataaacgcgaagagctcaactatgaatatgatcgtgaagtttttagtagtgttcacagagtatatctttcaaagaaaaaatctattttaaatgtcatattctctttgttttcaaatactcccctacagattgggtattataaatctaaagaatttgaagataaacttaagcagttattacctgaacattctgcaactctttcacatttgataagggttggtgattatgtgaaagagaataaagatataaattttttagagatgaccgatgccatttcacttaattataaacgagtaaaggaaaaagcatctttattgagtttaaaaacatttgtatattcttttgaacaaaaaagactcgaacgatatgagcgaactataaataacaagttcagcttgactactttggtatcacaggttgactccgattatttatatccagaccgtccgaataatgtattagtctgtggaaatggtgttgatgccgttagcttacctttttcagaacgaaaaatagctaaagataaaaagataacccttgtatttataggtaatttatattctttgcaaaatatggatggtgtgagatggttcaccaaggaagttttaccatttcttaacaagcatggtaattttgaatttaaggtcatcggacgtattacagataaagataagagttggttagaaagccagcctggcgttgttgtcacaggtgaagttgatagcataacttatgcagcagctgatgggcatattggtgtatgtcctattagattaggggcaggtatccaaaataaggtacttgaatatatggcgttgggattaccttgtatctcttctactgtaggctttgaaggcttgggagcagaggagggtaaggagatttatgttgccaatacaaaagaagaatatttacgtgtattaaattattttataacaaatctggataaatataccgaaacagcattagttgcgaaaaagtttatcggtgagaatttttcatgggaagctaaattgagcccatatatccagaaaattaaggagtctgttaaataaaatgattatcccaattattatggccggtggttctggtactcgcttatggcctctttcgcgttcgttatacccgaaacaatttttatcattgattaatgaaaatagtttgctccaggaaacgttgaagagacttgatggattaaattgtttgcctcctgtcattgttagcaataatgagcatagatttattgttgctgaacaattgcgacagttcggtgtggatgacttccagattattctagaacctgtaggtagaaatactgcgcccgccgttgcgctggctgctctaaagtctctagaactccatggcgatcatcatatgctggttcttgctgctgaccatgctattcaggatattgaagccttccatgcagctgttttagctgcagaacaagagtccgttgacaataagttagtgacttttggcatcgtcccgaccaaacctgaaactgggtatggctatattaaaaagggcgaacaagttaaaaactctgtatttaaagtaaattctttcgtcgaaaaacctgatttagaaacggctaaaaattatctcgaacaaaaatgctatttgtggaatagtggtatgttcatgttcaaggcgagcgtatatttagatgaattgaaaaaatttcgccctgatattttagcagcgtgtaaagagtcgctttccagtgctagtactgatctagattttatcagattaaattctgatgtctttgcagaatgtcccgatgagtcaattgattatgcggtaatggaaaaaactcaggattgtgtagttattccacttgatgctgactggagtgacatcggttcatggacatcactttgggaaatatcagagaaagatgaacatgaaaacgtatcgcatggcgatgtaattaactataacagcaggaacaactacatttactctgaaggttcactgatcagcactgtaggagttaataaccttattatagttcaaactaaagatgcgctcctggtagcacagcaagacaacgtacaagacataaagaagattgtcgaaattcttaaaaagcaaaaacgtagcgaacatatatcccatcgcgaagtctatcgtccttggggacgttatgattctgtagaacgtggcgaccgttatcaggtaaagcgtattaccgttaagcctggtgaatgtctctcaacacaaatgcatcatcatcgagctgagcattgggtggttgtcgctggtactgcaaaggtgacttgcggcgaacgcacttttttcgtcactgaaaatgagtcaactttcataccaattggcacagttcataccttggaaaatccaggaaagataccattagaagtaattgagattcagtcgggtgtatatctaggtgatgatgatattgtgcgcctaagtgataaatatggtcgtgttgaggataaataattatatgaatattaccaatgatgtaattaaaaatagcggaattgcatttggtacaagtggtgctcgtggattagtgaaagattttacacccaacgtgtgtgctgcattcacttatgcttttatcgatgtaatgatgaaggatttttcttttaaagaggttgcgctcgcaatagataatcgcccaagcagctatgctatggcacaagcttgcgcagcagcattgttggaatgtagtattaaacctatttactacggtgtaattccaactccagctttggcaaatcaagcgattgccgatgggattcctgcaataatggttactggaagtcatattccatttgatagaaatggtttgaaattctatcgtccagacggggaaatttcaaaagaaaatgagaacagcattatacatgctgaaaaagagtatcctgatgtaactgtattgccagaattacaatgttcaaagcgtgccgctgatacttatatcgagagaaacacttcaattttttcaaatatatttaaaggtaaacgtatcgggatttatgaacattcaagtgcgggacgggatctttattcagaaatattcagtaagcttggtgctgaagttgtaagtattggtagaagtgatgagtttgtgcctattgatactgaagcagtatcaaaagaagatgaagaaaaagctttacactggtcatctgagtatgacctcgatatgattttttctaccgatggtgatggcgatcgtcctttggttgctgacgaaaatggcgtttggttacggggtgatatattaggactattttgctcaaaggcaatgaatattgaagcggtagctgtacctgtaagttgtaatacggttattcagacttgcgggtggtttaatcatgtaacgctgactaaaattggttcaccatacgtcatttcagcgtttgattctctgaataatagttttgatagggttgcagggtttgaggctaacggtgggtatcttttaggtagcgatgtaaattataacagcggtatgattaaagcgcttccaacaagagatgctgttttgcctgctttaatggtactggcactggctataaaaaataatgtgactatttcaaaactcttggcggagttgccaccacgatttacctactcaaatagagttcaaaattttgcaacaagcaaaagcaaaagcattattgcgtcagctcaagaaaatcctcaagaatttatcgaaagaataggctttgtcgatcttcatgtacaatcggtggatacaattgacgggttaagattgacactaagtgatggttcaataatccatttgcgaccgtcaggcaacgcacctgaattgcgatgctatgcagaagcagataacataataaaagctgaaaaattagtgttagaagttttgcataaagttactcttttgtaaaaaaatataaacttttttctactcttgagcggtttgtcatttaaccgctcagtaatagattgtttataaattgtttatatttagcattggtgtttttatttgcgttcatcccgaataagagattgtaaaattaactgtttcttatttttcaaatgagttacttcactagtaaagctaattactatgcataagcaatattattcattattgtgcaataaaatacagtttaaacatctggctatatatttttctgtatttctttcactatcctcatgtttcttgtggggaggggcggatacatttgtatcgcaagtgtatattgatattttagccactatatctacagcgctattagttgttttgatgttctattattatattaatagagttcgctatttatcactaaccttactttttgcattcgttttttctttgattattggtttgccatcgatttatctttactattttaaaaacgcaaatcatgggtttgaaataatttgtatctgggggatgttgatcaattccatcctttacttgcaaacaacagagactgtcataaaagaagaaaaaagatatttaactagtttattttatattttgttttctattgttgcactgtgtcaattatacaaaatattaatttatcttatgtttatattgaattcaggagaagggcatttagcaatttatactgaaagcgaagaattgctatcccaagttccattttttattcgtgctattagtggttttgcagttgtaatgtcattgtccactttttattttaaaacaccgacctacattaaagttattgcatttgttttacttgcatctgatttagctattggaatacgtaataagtttttcttttcagtgatttgtatttttatactatatatgtactctaatgagtatagagtaagaaatttatttaagcaactctcaaaaccaatatttctcatcgccggttttttatgcttctcgatggtatcgtatttccgtgaagggtaccaaatcgattttatgatttatattggcattgttttagattcgctatcctctactcttggggggatgcagaatttgtttgatatgcaatcatcaggatgggatcaacttcatcccgctgtggtattcacacaagtattaccgctaagcggtcttggttttcttgatgatcaacaaatcgcaaaagatttttcaataattgttttaggtgatgtatcctctggtattgcgttgtcatcttcaggattgttagagtcatcgttgctgagtctaaacttgggagtgattatttatttactgtatttatcaggggtgatgctttttattaaatggggactaaataatcaacggataataataaactttgttgccatctccatgatatctggatttttttatgctgttcgtggtgaactgattttgccattggcttttcttctaaaatcattgccgattgttcttatatctccattacttgttaaaaataaaatttatcatggtcagtaagtggtttatttttcgaccaggatctcaccagtaggcatgacatgatcaaagaaattttctccgatggcattttttcgctatttaataaaatatgttacttcggttttaaaacacttgcaataattctgattactcgttccttaggagaagatgtaggcggagagttcatttttttagttggttttctcgaagtccttcgggtggttactgattttggtgtggatctgtttgttataaaaaaatataatgattctacagataaaataaaactattaaatgtaacgtttgcacaaaaaattctttctggagtaattgttttactactgttttgtttgtattcttttgttcagggttatcaatataatgtctatattcctattgtgttagccttacctgttgctttattttttaatttctcaaatagctattttcaatctctcaattccaataaatctctcacgtttccgatcgcaattgcatctattgcaacgtgtacgatcttcgctattcagtattttttaaacgttaaatttaacgcatgggattacctgtgtgttgaactattattcgtatcgctggttacactaaaactattcgttagtgtcaagtttaggtttattagaacgtcagcttttgatgtgctaatgtcaattctttctttatataaatatacattaagtataggtcttacagctgttgttgtaattatttatagccgtatagataatttttatctcaagacatttgccccaggggatcttgcagcatatggccagatatttaggatggttgatccactggttatggtttcttctgtattttctacagttgcctatgcaagattttgccgaattaacttacaagaaaaaaatgcttttactaaggtgtttcagttcctgttatgtattgtggcatatggcgtgctgagttcattagtttatttctttataataaaatacctgggtcattttgtattgatttctaatgttaataatgatttcttgataatgatgttcttgattgttgcatgtgtgaaatgtatcaatggtggtacaactgcaataattcagtcacaggggttttataaagtgggtttgtatgtttcgtatgtttgcattttgacatcgataccaactatgtatttcttaataatgaagtacggtgttaaaggtgctgctatgacgattctgcttgtagagtgtattagtttcatattacttctctgcagcttttttatgataaaaaagatgcgtcctaaaaaaacattcgaaatgtaatcaatgagtcctctttgaatagaattagtttgttctatttatgaacacttagcttgagtaagttctaacatagattactaattgtttgatactatctgctttacaagcataaccgcgtatgtcgcggtgaccacacctgacaggagtatgtaatgtccaagcaacagatcggcgtcgtcggtatggcagtgatggggcgcaacctggcgctcaacatcgaaagccgtggttataccgtctccgtcttcaaccgctcccgcgaaaaaactgaagaagttgttgccgagaacccgggtaagaaactggttccttattacacggtgaaagagtttgtcgagtctcttgaaacccctcgtcgcatcctgttaatggtgaaagcaggtgcaggcacggatgctgctattgattccctcaaaccatatctcgataaaggtgacatcatcattgatggtggtaacaccttcttccaggacactattcgtcgtaatcgtgagctttcagcagagggctttaacttcatcggtaccggtgtttccggcggtgaagagggggcgttgaaaggaccttccatcatgcctggtgggcagaaagaagcctatgaactggttgcaccgatcctgaccaaaatcgccgcagtagctgaagacggtgagccatgcgttacctatattggtgccgatggcgcaggtcactatgtgaagatggttcacaacggtattgaatacggcgatatgcagctgattgctgaagcctattctctgctaaaaggtggcctgaacctcaccaacgaagaactggcgcagacttttaccgagtggaataacggtgaactgagcagctacctgatcgacatcaccaaagatatcttcaccaaaaaagatgaagacggtaactacctggttgatgtgattctggatgaagcagcaaacaaaggtacgggcaaatggaccagccagagtgcgctggatctcggcgaaccgctgtcgctgataaccgagtctgtgtttgcacgttatatctcttctctgaaagatcagcgcgttgccgcgtctaaagttctctctggcccgcaagcgcagccagcaggcgacaaggctgagttcatcgaaaaagttcgccgtgcgctgtatctgggcaaaatcgtttcttacgctcagggcttctctcagctacgcgccgcgtctgaagagtacaactgggatctgaactacggcgaaatcgcgaagattttccgtgctggctgcatcatccgtgcgcagttcctgcagaaaatcaccgatgcttatgccgaagatccgcagatcgctaacctgctgctggctccgtacttcaagcaaattgctgatgactaccagcaggcgctgcgtgatgtcgttgcttatgcagtacaaaacggtatcccggttccgaccttcgccgctgcggttgcctattacgatagctaccgtgccgctgttctgcctgcgaacctgatccaggcacagcgtgactatttcggtgcacatacttataagcgcattgataaagaaggtgtgttccatactgaatggctggattaatctgatttaaccaacaataaaattgaggcccggcgtatattgcaccgggctttttttttgccaattatcttatagactaaatttcactgcttaatattaacttaataaatatcagctattcttataaagaaattctgaattgtttttcgttgcgttgaccatcttacaacgtagcgttaaaacttttaactcttatcaggatgctaaaaacatcatgattcacagttaagttaattctgagagcatgaaatgaaaattaccatttccggtactggctatgtaggcttgtcaaacgggcttctaatcgcacaaaatcatgaggttgtggcattagatattttaccgtcacgcgttgctatgctgaatgatcggatatctcctattgttgataaggaaattcagcagtttttgcaatcagataaaatacactttaatgccacattagataaaaatgaagcctaccgggatgctgattatgtcatcatcgccactccaaccgactatgatcctaaaactaattatttcaatacatccagtgtagaatcagtaattaaagacgtagttgagataaatccttatgcggttatggtcatcaaatcaacggttcccgttggttttaccgcagcgatgcataagaaatatcgtactgaaaatattattttctctccggaatttctccgtgaaggtaaagccctttacgataatctccatccttcacgtattgtcataggtgagcgttcagaacgcgctgaacgttttgctgcgttgttacaggaaggggcgattaagcaaaatatcccgaccctgtttaccgactccactgaagcagaagcgataaaacttttcgctaatacctatctggcgatgcgcgtagcgtactttaatgaactggatagctatgcagaaagtttaggtctgaatactcgccagattatcgaaggcgtttgtctcgatccgcgtattggcaaccattacaacaatccgtcgtttggttatggtggttattgtttgccgaaagataccaaacagttactggcgaattatcagtctgtgccgaataacctgatttcggcaattgtcgatgctaaccgcacgcgtaaagattttattgccgatgccattttgtcacgcaagccgcaagtggtgggtgtttatcgtctgattatgaagagcggttcagacaacttccgcgcgtcttccattcaggggattatgaaacgtatcaaggcgaaaggcgttgaagtcatcatttacgaaccggtgatgaaagaagactcattcttcaactctcgcctggaacgagatctcgccactttcaaacaacaagctgacgtcattatctccaatcgtatggcagaagagcttaaggatgtggcagataaggtatacacccgcgatctctttggcagcgactaacatcttgttatcagggctatttacgccctgattgtcttttgttacttcctcaataattcattatttttatcacttatcctatagcattcacgaggattatcgctaaactatgcggacttggaaatttccgtcagttagggtaatgatgagagtagaaaataataatgtttctgggcaaaaccatgacccggaacagattgatttgattgatttactaatgcagttgtggcgtggcaagatgacaatcatcatctctgtcattgttgctattgccctggctatagggtatctggccgttgccaaagaaaagtggacttccacagctatcgttactcaacctgatgtggggcaaatcgctggctataacaatgccatgaatgttatctatggtcaggctgcaccgaaagtgtcagatttgcaggagacgttgattggtcgcttcagttctgccttctctgcattagcagaaacgctggataatcaggaagaaccagaaaaacttaccatcgaaccttctgttaagaaccagcaattaccattgactgtttcttatgttgggcaaactgcagagggcgcacaaatgaagttggcccaatacattcagcaagttgacgataaagtgaatcaagagctagaaaaggatctcaaagacaacattgctctgggacggaaaaacttgcaggactctttaagaacgcaggaagtggtcgcgcaggagcagaaagatctgcgtatccgtcagattcaggaagcattgcagtatgcgaatcaggcgcaggtgacaaaaccacaggttcagcagactgaagatgtgacgcaagatacgttgttccttcttgggagcgaagcactggagtcgatgattaagcatgaggcgacccgtccgttggtgttctcaccaaactactatcagactcgtcaaaacctgctggatatcgaaagcttaaaggttgatgatcttgatattcatgcttaccgttatgtgatgaaaccgacgttacctattcgtcgcgatagcccgaaaaaggcaattaccttgattctggcagtgctactgggtggcatggttggcgcggggattgtgctggggcgtaacgctctacgcaattacaacgcgaaataatctttgcagttttaaagaaaatgggcagggtggtgacaccttgcccgttttttttgccggatgcgatgctggcgcatcttatccagccaaaatgtgcagagcgaatagtaggcccgataagcttgcgcatcgggcaatggctacggatgcgactacaacatcgcatccggtcagtccgcaactcactgatgccgtttgcgcaggttctcaatcaccgtcgttaaatccagcccctgatcctgcaacagcaccagcaggtgatacatcaagtcagatgcctcgttggtcagctcaaagcggtcatgtaccgttgctgccagcgcagtttccaccccttcttcgcccactttctgcgcgatgcgtttggtgccgctggcatacagtttggctgtgtaagaggtttccgggtcggcagatttacgttcggcgagcagttgttccagttgatacaggaacagccactggtgagcggtgttgccgaagcaactgctggtgcctttgtggcaggtcgggccgatgggattcgccagcactaataaagtgtcgttgtcgcagtccgacgcaatactcactacgttgaggaaattacccgacgtttcgcctttggtccacagtcgctgtttagtgcgcgagaagaaggtaactttgccactttcgatggttttgtccagagcttccgggttcatatagcccagcattaacacttcgccagataccgcgtgttgtacaatcaccggcatcagtccgtcggttttttcccagtccagttcgtgacgttgttgttctgttaacatatcctgatctccacgccctgtgatgccaggtacgcttttaattcactaatattgattatttgtttgtggaatacagaagctgccagcgcgccgtcaacgtcggcatcgcggaaggcttcgaggaagtgttccatggtgcccgcgccaccggaggcaatcagcgggacgtggcaaacttcacgcacttttttcagttgatcgaggtcgtaaccgtttcgtacgccgtcctgattcatcatgttgaggacgatttctccggctccacgtttttgcacttcctctacccagtcgagtgtttcccactgagtgacgcgggtgcggctttcatcgccggtatattgattcacatgatatttaccggtttcggcgtcgtaccaggtatcaataccgaccacaatacactgcacaccaaaacgatcggccaggcgagtaattaacgtcgggtccgccagcgcaggggagttaatggagattttatccgcgccaaaggaaagaattttcgcggcatcttccagagacttaatcccgcccgccacgcagaacggaatgtcgatcacttccgccacgcgcgatacccagcttttatctaccacacggccatcgctggaagcggtgatatcgtagaacaccagttcgtctgcaccttcttcggcgtagcgttttgccagcggtacgatatcgccaatgatttcatggttgcgaaactgtacgcctttcaccacctgaccatcacgaacgtcgagacatggaattatgcgttttgccagcatgcgatggcctccttcacggtgaatttaccttccagtaatgcgcgaccgacaattacgccgcgcacgccagttccacgcatggcagcaacatcgttaatgttgccaatgccgccggatgactgaaatgccacctgcggatatctggcgcacacttcttcatataaagagacgttagaacctgccagcgtgccgtcgcgcgagatatcggtacacagcacatgtttcaggccgacgggcagataggtttccaccagttgttccagtgaaacgcccgagttctcttgccagccgctgactgccacctgcttgttgccttgctcgtcaatacggacatccagcgccagcactaaggcatcggcaccgaaacgttcaaaccagcctttcaccatttctggtgatttcaccgcggtggagccgaccaccacgcgcgcaacgcccgcttccagtaacgccgccacgtcttcttcgctacgcacgccgccgccaacctgcaccggaacgttaacgcccgcgaccagggttttaatcagtgggatttgacgtttagccggatcttttgccccggtcagatccaccaggtgcagcacttcggcaccctgcgcggcgtaatcctgcaatcgcggcagcgggtcgttaccgtaatcgcgttgtttgccgtaatcgccctgatggagacgcaccacggtgccgtcgattaaatctaatgccggaataatcattacatctccaggaagtttttcagcaacttagcgccagcggcaccagaacgctccgggtgaaactgcacgccgtagaagttatctttttgtaccgccgcggtgaacggttcgccgtaattacactgggcgatggtccacggattgactggcattgcgtagctgtgaacaaagtaaaagtacgcgccgtcttcaatcccctgaaacaggcggttgcctgcctgcgggtaaacgcggttccagcccatatgcggcagtggcagaccaaagtcggtcattttcggcacgtcttcgtcgatgatgcccagcaaatcgacgccgttgctctcttcgctgcgccgccccagcagttgcatccctaagcagatgcccagcaccggttgggtacaggctttgatgagatcaaacagctcgcgctcacgcacctgatccatcgctgcttgtgcggtgccgacgccaggcaaaaacagtttatcggccagcaacaccacatcaggatcacggctgactttgggttcataaccgtggcgcgcaatggcagacttcaccgagttcaggttggcgcagccagtatcaaggatcaccacgttcattacagcactcctttcgacgagggcagggtatcgccttccacgcggatggcctggcgcagggtgcgaccaaaggctttgaacaggctctctacacggtgatgatcgtttttacctttggttttcaggtgtagcgtcacgcccatggtgtatgagagcgaacggaagaagtgctcgatcatctcggtgctgagatcgcccacgcgctggtaggtaaattcagctttatattccaggtgcggacgaccagagatatccagcgcgcagcgggcaaggcattcgtccatcggcagcacaaaaccaaagcggcaaataccgcgtttgtcgccaagggcaatttttaacgcttcacccagcgccagaccagtatcttcgacggtgtggtgatcgtcgatatagaggtcgcctttgacgttgatttccatgcggaaaccgccgtgggtggcgatctgatccagcatatgatcaaagaagccaacgccggtgttaatcttgctgccaccctcgcgatccagccacacctgaacgtcaatctgcgtctctttggtgttacgcactacatgggcgtaacggtctcgtttagtgagttgctcgccaatcatcggccagttcagggtttcgcggtcgtagcgtaaaccattaatacccatgttttccgccagttgaatatcggtcgcgcgatcgccaatcacataactgttggcacgatccatcgcttgctcagccagataacgctccaccagttttactttcggcttacggcagtcgcactcatcggcgggcaggtgcggacaaatcagcacttcatcaaactgtacgccttgcgaggtgaagatctgcatcatcaggttgtgcgggccatcgaaatccgcctgcgggaaactttgtgttcccagaccatcctgattagtgatcatcaccagcttgtagcccgctttttgcagcttcagcagctccgggatcacgcctggttcaaaggcgagtttgtcaaaacggtccacctgaaaatcactcggcggttcgctaatcagggttccatcgcgatcgataaaaagatacttctgactcatcaaacttgctccgcacgtaaggcgtcaatgacgcgctggctttcttcacgggttccgacggtaattcgcaggcagccgcttaaagagggttgtttattctgatcacgtaagataatgccctgatcccacaaagatttaaacactgcgctggaggctttaaagcgcgccagaatgtagttggtttcagagtcaaaaacctgctccacgcaggagatttctttcagtgcggcaatcagatattcgcgttctgcaataatttgcgccacccgttcgcgcatggcgacgatcccctgcgggcttaacgcctgggccgcaatgtcggcaaccggcgtcgagagcgggtagggggcgatcactttcatcagcaggttgatgacttcttcgtttgccagcgtaaatccgcaacgaaggcccgccagagcaaaagctttcgacagtgtgcgcaaaatagccaggtgcggatattccgtcagccagccagccaacgatgcctgcgggcaaaactcgatataggcttcatcggcaaccacaatggcttttccgcgggttagctccagcagaatgcgaaaatcctgcggattgatcagttgcccggtcgggttgttggggctgcaaacatagaccacttttacgccgtccagcttgtcggaaatgccctgtaagtccagttgccagttgtccagcgtcggcactgtgcggcactcgacgccaatggtttcagcgctgacgctgtacatgccgtacgttggcgggtagtagaggatggcgtctttacctggttcgcaaaaagcgcggatcagcagttcaataccttcgtccgcgccacggctgaccagcacctgctccggttttacgcctgcatactgcgcgtaattttcaatcaccgctttcggctgacattccgggtagcggttgagcgtttgctgagtaagctgaaactccacggctgtgggatattcgttggcgttcagccagacgtcgccgttaccgcccagacgacgcgccgactgatacggcgtcaggttgcggacgttttcacgcgctaaatcggtaatagtcacggtgctcatgcttgctccttaagggcgttaacacgcaaagtaacggcatttttatgggcggtcaggcgctcggcggcggccagtgtttctatggtcgaagccagcgcagaaaagccttctttcgacagttcctgcacggtcatgcgcttctggaaatctgccagcccgaggctggaacaggtggcggtgtaaccgtaagtcggcagtacgtggttagtgccggaggcgtaatcacccgccgattcgggggaccagtcaccaagaaataccgaaccggcgctggtgatgccatcgaccagatcgcgggcgttgcgggtctggatgatcaggtgctctgggccgtactggttggagatctccacgcactgcgctaaatctttagtcacgatcaggcggctggcgttcagtgcctggcgggcggtttcagctcgcggcagttctgccagctggcgttcgacagcttcggctacgcgacgcgccatatcagcagcgggcgtcagtaaaatcacctgagagtccgggccgtgttcagcctgggagagcaaatcagaagccacgaaatccggcgttgcgccgctgtcagcaatcaccagcacttccgacgggcctgcgggcatatcgatcgccgcaccgtccagacgctggctcacctgacgttttgcctcggtgacaaaggcgttacctggcccgaagattttgtccactttcggcacggattctgtaccaaacgccagcgcggcaatggcctgtgcgccgccgacgttaaacacgtcctgcacaccgcacagctgcgccgcgtaaaggatctcatcggcaatcggcggcggtgagcacagcaccacttttttacagcccgcaatacgcgccggagttgccagcattaataccgttgagaagagcggggcggagccgccaggaatatacaaacccactgaagccaccgggcgcgtgacttgctggcaacgtacgcctggctgcgtttctacatctaccggcggcagtttttgcgcagtgtggaaggtttcaatattctttactgccaccgccatcgcctgttttagctcgtcgctcaggcgttcgctggcggcggcgatctcctcagcagacaccttcagcgcggtaaccgtggttttatcaaacttcgcgctgtattcccgcagggcgtcatcaccgcgtgctttcacgttatcgagaatatcgttaacagtgcgggtaatgctttcagaagcggagatcgccgggcgcattaacagctggcgttgttgctccgcagtacagctattccagtcaatgattgtgttaaagctcatggcgatcactccatcatcttctcaatcggcagcaccaggattgaactggcacccagcgctttcagtttttccatcgtttcccagaacagggtttcgctactgaccatgtgcatcgctacgcgctgttgatcacctgccagcggcagaatagttgggcgttcggcacctggcagcagggcgatgacttcatccagacgttcagtcggtgcgtgcatcatgatgtattttgattcgcgcgcctggatcacgccctgaatacggatcatcagcttgtcgatcagttgctgtttagattcttccatttcgccatcgcgctggatcaggcaggctttcgagcggtagataacttcgacttcgcgcaggccgttagcttccagcgtggcaccggtggaaaccagatcgcaaatcgcatccgccagtccggcgcgcggggcgacttcaacagaaccgttcagtaagcaggatttaaaagagatgcctttctggtcgagataacgcttgagcaggtgaggataagaggtggcgatacgtttaccgtttaaggagagcggaccgtcccaggcttcatcaaccggcgttgccagcgaaaggcggcagccgccgaaatccagtcgacgcagggtaaagtagcgcggatcttcaccctgggctcggcggttaagcagctcttcttccagcacgttttcgccgataatcccaaggtctaccacgccgtccattaccagaccgggaatgtcgtcgtcacgcacgcgcagaatatcaatcggcatgttttctgccatcgcgatcaggcgctgggtgtgaagattgattttaatgccacagcgcgccagcaattcgcgtgagtcatcacttaaacggccggatttctgcatagctatgcgtaaacgagtgttgtctgtcattttcttattcctctttaaacctgtctgaaccgttatcaaccgcgcaataaaaaagcccccggaaggtgatcttccgggggctttctcatgcgttcatgcaccactggaagatctgaatgtcttccagcacacatcgcctgaaagactagtcaggatgatggtgatgatggtggtgtttaaattgaacgcgtgtcataaaagtctctgtgaatgtttattcaactgatgtcttttaacctaaaccactttcacgttagaaagcaagggcttttttatatattttatggcgatggatttgtttaatgaatgagcggggaaaggagggggcctggagtgactacgttagaaaagtaatcgtgaaaatatgtctttaaaaccctcaagaacattgtgttctgtaactaaagtgggctttgttcctgccggatgcggcgtgaatgccttatcaggtctacaaatgttgcctaaattcaatgtattgatgtttttgtaggactgataagcggagcgcatcaggcaactgtatatttgctaacagtttcgatttcattcatagaatgaattgtcagttttgatacgctagcgtagccttatagatctaaggtgtatcaggagataacggatgaaaaaggtcgcaattgtcgggttagggtggttaggcatgccgctggcgatgtcactttcagcgcgaggctggcaagtcaccgggagtaaaaccacacaagatggtgtcgaagcggcccgaatgagtggcattgatagctatctgcttcgcatggagcctgagttagtttgcgattctgacgatctggatgccctgatggatgccgatgcgctggtcattacgcttccggcacgtcgtagcggccccggcgatgagttctatttacaagcggtacaagagttagtggatagcgcgctggcccatcgtattccccgcattatttttaccagctcaacatctgtctatggcgacgcgcaaggcacggtgaaagaaaccacaccgcgtaatccagtaaccaacagtggacgagtattagaagaactcgaagactggctgcacaatttacccggtacttcggtcgatattctgcgtcttgcgggcctggtcggaccgggacgtcatcctggtcgcttctttgccggaaaaaccgcgcctgatggtgaacatggtgtcaatttagtccatttagaagatgttattggcgctatcaccctgttgttacaggcacctaaaggcggacacatctataatatatgtgcgccagctcaccctgcgcgtaatgttttctatccgcagatggcccgtttactggggctggaacctccgcagttcagaaatagtctggacagcggcaaaggtaagattattgatggcagtcggatttgtaatgaactgggatttgaataccagtatcccgatccgctggtaatgccgctggagtaaacgatcacgccagcaggacgccgcatgcactgcaagggggcgtgtatgaaaccactgctggatgtgttgatgatcctcgatgccttagaaaaagaaggcagttttgcggcggcgtcggccaaactctataagacgccgtctgctctgagttacaccgttcacaagctggaaagcgaccttaatattcaattgcttgatcgtagcggacaccgtgctaaattcacccgcaccggaaaaatgttattagagaaagggcgggaagttctgcataccgtgcgagaactggaaaagcaggcgatcaaactgcacgaaggctgggaaaacgagctggtgattggcgtggacgacacgtttcctttttctctgcttgctccactcattgaagctttttatcaacatcatagcgtgacgcgcctgaagtttatcaatggcgtactcggtggttcctgggatgccctgactcaggggcgagcggatattattgttggcgcgatgcatgagccaccatcttccagtgagtttggtttctcgcggttgggcgatctggaacaagtctttgcggtcgcgcctcatcatccgttagccctggaagaagaaccgttaaaccgtcgtatcattaaacgatatcgggcgattgtggtgggggacactgcacaggccggcgcttctacggcctcacaacttctcgacgaacaagaagccattaccgttttcgattttaaaaccaagctggagctgcaaattagcggccttggctgcggctatttaccccgttatctggcgcaacgttttctcgatagtggcgcgttaatcgagaagaaagtagtcgcccaaactctctttgaacccgtctggattggctggaacgaacagaccgcagggcttgccagcggctggtggcgagatgaaattttagcaaatagtgcgatcgccggtgtttatgcaaaatctgatgacggaaaatcagccatttaaagaaaaattattatgacaagcctctcattctcttgtcatttcccccccatttaggcacaatgcgccgctgtcaaaaaatgactaaaaaccgacgtttcatcagcgtcggttattttttgcttcaaaccaatcattcataccaagaggccgggcttcgtaccggatagatatttactaaaaatcgacagttgttgtcgctgaggaatccaaaaaaatggggcaattttttgcttacgcgacggttatcaccgtaaaggagaatgaccatgtcgcataacgttactccaaacacctctcgcgtggaattgcgtaaaacgcttacgttagttccggttgtaatgatgggtcttgcctatatgcagccgatgacgctgtttgatacttttggtatcgtttcaggcctcacggatggtcatgtgccgacagcctatgcgttcgcattgattgcgatcctgtttacggctctgagctacgggaagctggttcgccgctatccttctgctggctctgcatacacttacgcccagaaatccattagcccgactgtcggctttatggtgggttggtcttctctgctcgactatctgttcgcgccgatgatcaacattctgctggcgaaaatctattttgaagctctggtgccttccattccatcgtggatgtttgtggtggcgctggtggcctttatgaccgcctttaacctgcgtagtctgaaatccgtagcgaacttcaacactgtaatcgtcgtgttgcaggtagtgctgatcgcggtgatcctgggcatggttgtttatggcgtatttgaaggtgaaggcgcgggtacgctggcgagcactcgtccgttctggtctggcgatgcgcatgttatcccgatgattaccggggcgacaatcctgtgcttctcctttaccggctttgacggcatcagcaacctgtcggaagaaaccaaagatgcagagcgcgtgatcccgcgtgcgattttcctgaccgcgctgatcggcggcatgatcttcatctttgcaacttacttcctgcaactgtatttcccggatatctctcgctttaaagatccggatgcgtcacagcctgaaatcatgctgtacgttgcgggtaaagcgttccaggttggcgcgctgatcttctccaccattaccgtactggcgtccggtatggcggcgcacgcaggcgtagcgcgtctgatgtacgtaatggggcgtgatggcgtgttcccgaaaagcttcttcggttatgtacacccgaaatggcgtactccggcgatgaacatcatcctggttggcgcgattgctctgctggcaatcaacttcgacctggtaatggctacggcgctgattaactttggtgcgctggtggcgttcaccttcgttaacctgtcggttatttcgcagttctggattcgtgagaagcgtaacaagacgctgaaagatcacttccagtatctgttcctgccgatgtgtggtgcgctgaccgttggtgcgctgtgggttaacctggaagaaagctcaatggttctgggtctgatctgggcggctatcggcctgatttacctggcttgcgtaaccaagagtttccgcaacccggttccgcagtacgaagacgtagcataatcttacaagccggatgacataatcatccggtaaatctcaaaaagccggagtttatcgctccggttttttttgtttcagacgatctcttccgcgtactgccaaagtgcttttaacagcgtcactttctctttgtcatcggcatattgttgtaccagcatctgcaattcatcagcataaccctgcaaaaactctggcgtgaagacctggcggcggtgctccagccagcgttgctgctcggcataatccagcgtccccgggaagttgcgtgcccgataattgaacaacagcttttcaatccgtttatcaacaaaagtgatatccagtgccggtaaattacgcggctcggtttccagcacaattttcattgctgcacgatcggcgtcactgaaaaagccattataaagctgtgcatccacgttatctgaaggcgtaaacggttcggcttccgcgaatatcgccaccactttttcacgcacttgcggattttcacgcagaatttttaggttatcgaggcaatgctgacgattaattcccagtcggtcagcatcttccgggcgtagcgtattcgcctgggccagcaccggacatttattgatatgcaccagtttaaccggaacggcggcgttatcgccaagatcggtttttgcggtatatagacgctcgcgcaatgtgtcgctatccagttccagtaatggcgaaatgtctcctgccaaatccaccataattacggcattgcgattttcaggatgccacgccagcggtgctacccagctggtattgccgcgccatgccccaaacattccggaaacgtgaaccaggggtttcatctgcggaacatcaatcaacgccatcagtttgtgtttattacgatgggtaaagagataatcaaacaggcgtggctgacgcgtttttaccagttttgccatcgaaatagtggcgtacacatcagccatcgcatcgtgtgcgttgctatgttcaataccattcgctttggttaaatgctcaaggcgaaagctcggtagaccgtcatcattttcaggccagtttattccttccgggcgcagggcataacaggcacgcataacatccagtaaatcccagcgcgagttatcatgctgccagctccaggcgtaaggatcgtagaaattacgataaaaaacgttgcgtgtgacttcgtcgtcgaaacgcacattgttgtagcccagaatacaggtcttcggtacggtaaaaagcgagtgaatacgggcggcaaacgcggcttcgttttctcctttcgcccgtgcttcctgcggggtaataccggtaattaatactgctccaggctggggtaaatagtcatccgcgggcttgcagtaaaagacttcgggttcgccgatgacattgaattcgctatcggtgcgaatggctgcgaactgtgcagggcgatctaacgcggggtgcgtgccaaaggtttcgtaatcgtgaaacaaaaaggtagattgttgcttaccgtcattcatcattaggttaaatccgttgtttctgctgtctgccagagtatcaaatatcaccgtgctaatcagctttagcgcaacaatttgacagcgagtggcaacagatcatgtcagataaaaatgcgagggtagtcacattttcttgcactttattccagccagttcataagtatttccgtaaaaagaacagctatttgaaactcctgagggtttgctgttgaaacgccgtcttattattgctgcttctttgttcgtttttaacttatcgtctggttttgcggcggaaaacattcctttttcacctcagcctccagagattcatgccggctcctgggtattgatggattacaccaccggtcagatcctcaccgcgggtaatgagcatcaacagcgcaatcccgccagcctgacaaagctgatgacgggctatgtcgtggatcgcgctatcgatagtcatcgcattacgccagacgatattgtcaccgtggggcgcgatgcgtgggcgaaagataatccagtgtttgtcggttcttcactgatgtttttgaaagagggcgatcgcgtatcggtacgtgatttaagccgtggtttaattgtggattccggaaatgatgcttgtgttgctctggctgactatattgccggtgggcaacggcagtttgttgaaatgatgaacaactatgccgagaagctgcatctcaaggatacgcattttgaaacagtgcatggtctggatgcaccaggccagcatagctcggcttatgatttagctgtgctttctcgcgctatcatccacggcgagcccgagttttatcatatgtacagtgagaaaagtctcacctggaacggtatcacccagcaaaaccgtaacgggttattgtgggataaaaccatgaatgttgacggcctgaaaacgggtcatacttctggtgccgggtttaatctcattgcttcggctgtagatgggcagcgtcgtctcattgcagtggtaatgggggctgacagtgcaaaaggtcgtgaggaagaggcaagaaaattactgcgttgggggcaacaaaactttactacggtgcaaattttgcatcgtgggaaaaaggtcggtacggaacgcatctggtatggcgataaagaaaatatcgccctgggaacggaacaagagttctggatggtgctaccgaaagccgaaattccacatatcaaagccaaatatacccttgatggtaaagagctcactgcgccaattagcgcccatcagcgggtaggggaaattgaactttacgaccgtgataaacaggtggcgcactggccgctggttaccctggaatctgtcggggaaggcagcatgttttcccgcctgagtgattatttccaccataaggcttgacctttcttttgcagcagactggcaggagtgcgagtctgctcgcataatcaacactcattccttgtggttttaatattgcagctatactgtatataaaaacagtattaatggaggcgtcatgaactacgagattaagcaggaagataaacgtaccgttgcaggtttccatctcgttggcccgtgggagcagacggtaaagaaaggttttgagcagttgatgatgtgggtagataacaaaaatattgtgccgaaggagtgggttgctgtctattacgacaatccagatgaaacacccgccgaaaaattacgctgcgacaccgtcgtgacggtaccgaataactttacgctccccgaaaacagtgagggcgtcattctgacagaaatttcaggtggtcagtatgcggtggcggtggctcgtgtagtcggtgatgattttgctaaaccctggtatcagttctttaatagcctcttgcaagacagtgcttatgaaatgttaccaaagccctgttttgaggtttatttgaacaatggcgcggaagatgggtactgggatatcgaaatgtatgttgcggtgcagccaaaacatcactaattcatctcagggcggtgtgttaacgcgatgaccactcttttttttgaaagcgaaaagagtaagatgcgcctttcaattttttcgctcctgccgggaaattacactgttcccggtttgtccgtcggataattcagaggcgcgccttctggccgacagatgagttatgagcgcttttaatcttcattacggagtttctgcgtgcgtgccgataagtcattaagcccgtttgaaatccgggtataccgccattaccgcattgtgcatggtactcgggtcgcgctggcattcctgctcacttttctcattatccgcctgtttactatcccggaaagcacctggccgctggtcaccatggtggtgattatggggccaatctcgttctggggtaacgttgtccctcgtgccttcgaacgtattggcggtacggtgttggggtcgattttaggtcttatcgctctgcaactggagttaatctcgttaccgctgatgttagtctggtgcgcggcggcgatgtttctttgcggttggctggcgctgggcaagaaaccgtatcaaggtttattgattggggtgacgctggcaattgttgttggttccccgacaggtgaaattgatacggcgttatggcgaagcggcgatgtgatcctcggctctttactggcaatgttgtttaccggtatctggccacaacgagcgttcatccactggcgcattcaactggcaaaaagtctgaacgagtataatcgggtctatcaatctgcattctcaccgaacttactcgaacgcccacgtctggaaagccatctacaaaaactcctgaccgatgccgtgaaaatgcgtgggctgattgcgcccgccagcaaagaaacccgtattccaaaatcgatatatgaaggtatccagaccattaatcgcaatctggtttgtatgctggagttgcaaatcaatgcatactgggccacgcgccccagccatttcgtattattgaacgcgcaaaaactgcgtgatacccagcatatgatgcagcaaatactgctgagccttgttcatgcgctatacgaaggtaatccgcagccggtttttgccaatacggaaaaattgaacgatgctgtggaagagctgcgtcagttgctgaataaccaccatgacctgaaggttgtggaaacaccaatctatggttatgtgtggctgaacatggaaacggcacatcagcttgagttgctatcgaatctgatttgccgggccttgcgcaaataattcctgaacttcagaatcatcttgctgctgcttcgattcagcaaggataaagggtatgatagtgaaaagggataaaagcattgtcatctgcggcagctatgagtaatgttggccctaacgaatagcggttgcttaaacgaatccgactctcacattatcaggggtataaaaatggaaactaccaagccttcattccaggacgtactggaatttgttcgtctgttccgtcgtaagaacaaactgcaacgtgaaattcaggacgttgagaaaaagatccgtgacaaccagaagcgcgtcctgctgctggacaacctgagcgattacatcaagccggggatgagcgttgaagcaatccagggcatcatcgccagcatgaaaggtgactatgaagatcgcgttgacgattacatcatcaaaaatgccgagctctccaaagaacgccgcgatatctccaaaaagctgaaagctatgggcgaaatgaaaaacggcgaagcgaagtaattcctgttttattcaatgagggttgcccggcaaccctcattgctcattgattcttttctgtgtatcaccgtcatcattcccatctgagaacctgtcgaaattagcgacagaattcttctgtatgcagcaaggcaaaaagttctgcaactccattgttattaaccgcactggttactaacacattgtgcgctccagcttcccgtaaccaacatttcaccaaagatatttgttccatgttggctaaatctgctttggttactactccaataacagggcgattcattgacgaggtaaagcctggcgaaaaaggggaccacggtgcgtccgcattaagcaccagggcgataatgtccgcttcgcaggcgctgaccaacagagcactgtagaggctgcggttttcgaggtattcgcctggtgtatcaatggtggtcggggaccagacgattgcctgtgttttctgataatgaatattttcgccacgcagacattgcgtgagtgacgtttttccgcactggctggggccgataagcatcatacgttgcataacgtcaggtccgcgtaatggggcaggcggtaaagcgcatcatttcacccagcgtacgggtaacctggctaagtgcatattcaatggcagaaacatcaccagtcagcactacggcaccggtaaaacgatcaagaaaaccgatctctacagcgcctgattttgtggcgatatcgcatgcgatgatagatgcttcgctgggggttatcgtcagaatgccaatagcagaaacggtgtctggtaaacccaatttcttaaacagatccttcccaggattggcgatgacatgtgccagcgtgacctgcttaccagggacatattcctgaatcatccgttcagttgtgtgctgagttgtcattatccctccaccatctgacgccacatggcttcatgtggacgggcaatcaccgaccgatagaccaacaaacctttttctcccgcacgctcgctggcgacagagaccgcgttattaacatctgaaatatcgccagcaaccaccatgtagcattttccgccaatgccaaaagccatatgcacgcgaacgagaatgacattcgcagctttgacagcacaatcggcagcgtcaatgcaggcagcgacactccaggtttcgactacgccgacagcccggtgctgctcaacatggttcagtccgctgattgcagaaaggagactgggatgaatattcggcaggacaagactgtcgaccagcatttcaccagcaagggaagcaccgctgttgatggcctgttgcaccgcgcccacatcgccaccgagcatcagcagaaattttccggggcatagcgttttgctgaccagtaactcaacgttggcgcttttcagcatggcgtcgccggtttccatccctttcgcgatactgctaagttctaaaatacctaccgctttcgacatcgttaacctctcacaagcgtaattgcgttttctgtcacatcgctgaccatgccatcaatactggcatgaatgggggcacctaatgtgccgtgtggaatttgacctacacattgcccatgaacgacgcgatcgcctttttgtacacacgcaattgcgctggcaccgatgtgctggcgtaacaataacgtcactttttcgggctgaggcacctgttcagacaatggcgcatcctgataccacggggttaagcccagtctggttaccagccgttttacgggaaccagtcgataatttgccaagggatctgcaggatttaaggcaccttcgtagcggatattttgtgcgcgtaattcctgcttaagcaggcggtttatgcgcattggtgaaattcctaccggacaggcgacgctggcgcagacgttgcactccgaacaggtgagcgccgtcagtaacagttgtggcgtagcgagctgttggtagttaaccgcacgtactaataaatggggtgccagttcgtgaccgattaaatgacgtgggcagagatcggtacacaagcggcattgctcacaaacagttttcgcgacggcaagtacgctgcggtcattctgcatttgacgttggatcagtgaatgagagttgggtaaaaccagcaagccgccagtggttttgctgactggtgtgtcgagcgatgtgatcaaacttcccatcatcggcccgccattgataaaaccaggagcatccactgttgcgccgcccgccagcgccaggacttcacgtaaagacatgccgatggggacggttaccgttattggtttcgccactgcaccattaacggtgagtgtgcggcgcgtcactggatactgttgctcgacggctctggcaatattaagtacggtttgaacattattgaccaccacaccgacgctaacgggtaatgccgcgggtggaacgcggcgaccagttgccatccagatggtcagcacttcgtctcctgcggggtaaacatcgggcaaaatatgcaggcggatatccggtggtaacagtggtgtgagtgcgtttattgcccgttgatatttctctttcagcgcgatgattccgctactggccccggtggctttcatcgcatagtgaacaccgcgaagcaggcggctggcttgctgcgccattaactgttgatccactttcaacattggttcgcattccgccgcattcaccaggaacgtgtcaacacgcgcttgtagcttaatatgggttgggaaacctgcgccgccagcacccacgacaccagctgcctgtactcgctcgcggatggtctggtcgtcgcaggaggttaactcgacgttcataacaactcctcgagcagttctgcaatagcggtggcatcagccgcacgcgggttggtacgcaacgttgcatccgtcagtgccgcctgaaccatatctggtatgcgtattgaccattctgcttttttttctttcagcacattggtaagagtcggtagcttacaggttgttttaagctgttcaatatgttgaataagtgtattcaggctggcgatgtcattggcgttgtccgggcataaatggcacgttttcgccagccgggcgtagcgtttggcagcgcgcggatcgccagcattaaagcggataaccgccgtgagcaggagcgcattcgccaggccgtgtggcagatgaaactgtccgccgagttgatgagcaattgcatggtttaatcccagtccagcctggctaaaggccattcctgcaagtgtcgatgcattatgcattttgccacgggtggcgagacaatcgcctttcttcactgcagtgggcaggtattgaaaaacaatttgcacggctttttcgaccagtgcatccgtgaagtcgctggcgcggggagaaacataagattcaagcgcatgggttaaaacatccatcccggtattggccgttatcgccggtggcacgctgacgaccaaagatggatcaaggatcgcgatatccggataaagtgcattatcgaaaaggggatatttaatccctttctcaggatcgctgatgacacaagcactggtcacttcggaaccggtaccgctggtggtgggaatggctacgcaggtttcaatttcaatgccacactggcgaccgaaccagacaattgcttttgcggcgtccagggcagaaccgccgccaaaaccgataactacatccgggcgtaaagtctgcatttgcgcaatgcctttcaccacggtctggatagttgggtcgggcgttatttcgctaaaaatactgagacgattactgtcgggcagcgcctgatgcaacgtgtcaataagtggtgagcgtgccagaaagacgtcgcaaataatccagatgtgtttatgagagaaacggctaagtaccttgagacttcccggtccgctgtataaacgcgtctgcagtgaaaaagtattcatttctgtttctctagcgaattgaaaagccgctggttaacacgcagcgtcgtgagcgggcaaaagtccgtgctgacgttgtcccttctccggtcggtgttgcaatggtaaaggtcgtaaagccttcgccgccgacgccaatacccgcccaggaggggccgtttttgacaaagattgaggtttgcataacgcgtgcggcaaggttgagccgtgagacgttctgcgagtgcataattgccgtgtggtgcaagccgtcttccactttcagcgccagggtgagagcgctatcaaaatcgttgaccttcacaatgggcagcattggcatcagttgttcacaagtaacccaactatcattggcgtcgacaacagcaatcagtaggcgcggcgcttttgcgggcaaagggaggcctgccgcttccagcaaggctgatgggcttttcccaaccagttttttgttggcgctaccgtctggcaggcaaattgcacgcaatttctccgtttgctcatagttaagaagaagcgcgccaaaactttgcatctgctgaattaaataatctgccactgatgccacgacaatcaggcttttttcagcaatacacggcaggttgtaatcaaatgaagcgccgttgatgatgtcctcggcggctttcacaatatccgccgtttcatcgacgatgcacggagggttacccgctccggcaccaatcactttcttgccacttttcattcccatggcgacgatccccggaccgccggtaatcgccagaacgctgattttagggtgcgccatcatctgttcggtagcagcaaaggtcggttcagatacggtaacgatcaggttatgaatgccactacaacgaaacgctatgtcttcgattgtggtaatcagttttaacgaaacgtatttggctcccgggtgtggactgaagtagacgctattacctgctgccagcatgctgatgctgttgttaatgatggtttccgtggggttggtgcttggcgtgaccgagccaataaccccaaacggggagtattcaaacaaaaccatgccaccatcaccggttagtgcagtggtggttaaatcttcaattcctggcgtgttatcgagtgccgctttgttttttaggtacttatcttctttatttcccatccccgtttctttggcgctttcttctgccagttcggtcaggcggggtattaattcttcgcgaatggcgctgataatggcgctacgggttttaagcgggcactgttgaaagcgtaaaaaggcctggtgtgctgcgcagaccgcttcatcaacagtctggaaaatagcgtttctttgcattcgtggtgtagcggggacaagttgttcacgcagaatattgcggatcagtgtttctaattcagagttattcattggtttactcccacgttaattgccgccattgcgctttgggcaatatccatgtcttgttcaacgctaccgccactgataccaagcccgccaagcaattttccgtcacgccagagggggaagccgccaccaaaagtgacgactttgccttgcatatggctttcgagcccgtaaagcggcgcgccgggttgcacggtatcagcaagcttgtgggttgccgttttcatcgccacggcggtccaggcttttttcggtgccagttcactgctgaccaacagtgcatcaggcatccgccaggtaacactttctgttccgttggcatcaacaatgctgatgacaacgggaatatgcagttcatctgcgcgcagtgccgcactacgaatgagctggtgaagatcctgaaaagagagcggcattgtgcgttccttcaatgctggggtgtggttggcttcgtgataacgttttgtgatttcctgaatcatcaggttttgatgagcaacgttgtcttccacgcgggcgagggcatacagacaatcggaaagtcggttgatatagtgcagcaaaacattccggacggtggtttccgttgtcagttcaaccagacgtctttcagcccgtcgagccactgtgcgggcgaaatgcatgcggctcgcggcttcacatcgaccaggcagaatgaagctgtgaactggggggacggcgttcattgcgctatcgatcgcgttttccagcgcagcaatttcttccgtaccgatgtaacgctgctgcgctgacggctgttcgctttcactggcgagttcggcgctaaaccaaaatatctgttgttgaatggcttccagtaagatgcgatggctttcgatggcggtggcgcaataacacagactgagtgtcgcgttcagttcatccagcgtgccataggtttcgacacgtagatgagttttgctgacgcgctgtccggtaaataaagacgtacttcctgaatcacctgttcgggtataaattgccatctttcagctccttagcgcgaaagcgtatcgacaatgccgaccactgccaggtcgatggcctcgttagggccggaaaacacatgtctggcgctggaaccactgctgagaagtaccaactcaccaacgcctgcgccgactgaatcaacggcaacttcgtcgccggttaatggcgtgagaggtagttcgccgtcagcactgacccggcgaaccagcagcagttttttcccgatcagagatggtgatttttgcgtggatactaccgcgccagtgactcgagccagatgcataggttactcctgcctgattaactgaatatttcgggtaattgccgcttcacgagccagtgcggtcacacaacatttccgctgtaacaccagtattcccgagcttaactgtgcgatatcggcataacttaaaagtcgatcacgatgaaggtagatcggttgcccttgttcgtcgcaccagcttagcggtagacgggcgagagtcttcaattcaatggcgttcaggaaatgacgctgcaacgacaattgaatgtgcattccccaggctaacgcttcgtgtatctggattgctgctcgatctgacgtttcgttctccgcaagttgtcgcagcagcggcagatcgacatatcggatttgtaatgacgcatactgatgaacgctctcttgaacgctggcgtctcgcagttgaaaaacagtcagcacgagtgtttttcccgcacgttgtttaacgcgaaaaaccacctcgtcaacaatacgttgcatcagcatgttattcatggcactgacaccagtgtggcaaaaacgtcagggctatcagcgcctgcggcgttggcctcatcggtatcaatatgcatttcaagacgcatatccggagagacgcgaacagcgacgttttcgaatatcagtcctcgctcatcaccttcaatggcaaccgccactttatcgccatgcgtaacgccataaatcagggcatccagcggagacatatgaatatgccgttgcgcgacaatgacgccagatgtgatctccagttccgcaaatgggcttatcaaacgaatccccggagtgccgctgagatcgcctgacatgcgtagcggggcggtgatccctaacgttctggcgtccgtccgggaaatttccacctggcttgcattgcgtagcggccccaacaagcgaacgttgtgcaatttaccttttggtccctccagcgtaacaacctgttcagcagcgaattggccaggttgcattaacggctttttctcgctaatcggttgttcaggaaaaagacgcaaataatccgctgttgaaagatgaatatgacgactggaaacacccagagggatagggcgctcacgcatctcatccagaatctggctcactgtttcctgcaaggtttgtttatccactgctactcccctcgcttattggtgtgcaggcaaagtgagcggggctcacctttttgccgctgacatgccgggtcaagacacaaattacaactgataatctctgaggtgacggttgttgctggtgttttgcttgtttcaaccgtcacggtcaatgcttcaattgtgtggggcagaatgccgtctcccgggcgggcaatcactttgtgtgcgacaaggccatttcgctgtccggcgaaactggctcccgtcgcgatcgccgcattaaccgaggcgacgtcaccggtgattttgatgagcgtccagcctgagccattggtcttctcaaggccaaccagcgtgatggacgcggcttttgccatagcgtctgcgcaactgatggcgagagccagaccactgacttcaagtaatcccagtgattgcttcacgctgtgctccttagcaaatggggttatgccgatttaggtaaaatagcctcaacatcactgtgtgggcgcgggatgacatggcaggatttcacttcgccaactgcgcttgccgcagcgctccccgcatccacggcggcctttactgcaccaacatcaccgcggaccatcaccgtaatcagacccgaaccaatcttttcatagccaaccagctgcacgttggcggatttaaccatggcatctgcagcttcaattgcgccaactaacccttttgtttcaaccagtcctagtgcgttgttcatactgcgtttctcctgtggattatgagtggaattcccggaagggaattccttttaccaggcgggcagcgttagtgccgatgctgcgccgggcatggttatcttgttgatacatcagcgtaaacagtggcgctgatggtggtaagtttttgtaatgcacaatcagtttttcctgatcgcaggcaatgccaaccaacaggggagattgacgagcagccagccaggcgctatcgataacttcacctgacggaatgtgttgaatgcgaaagggaataccttcctcttcaatgccaagaagcacctcatcccatatagtgatgcagttaccgatctccatgacgacgatggctggtgcacgctctttactttccatgaatcgactccttgtgcaaggcgatgagtagcccagtagctaccgcgttgcgcggaccttcgctaccacggatattcccccgcccggcgaccagtcgataatgtgctagcgcgtcggtgaccaattgcggtacttcgaaatccagcgaagagccacccaccagaacgacaaacggaatgtcgcgaatatttccggcagggcttacctgacgtagcgcgcgcagggcattagttacgaagacacgctctttcgcactgcgacggacagcgcgtactttttccagcgtcaaatcaccgggaataggcaccagttcgtcgggtttcactacacagacacgggcaaatacatggggggacaggggagtagggaagaactgaacgctgccatcttcatggcgtaagtggaacaggctttctacttttgccaacgggtactttttgatttcttctgccagataacgatcatttaagcccagctcacgagcgataatcatcgttaccatgtcacccgctcccgcaaggtgagtggcaacaatttctcctttctgattgatgatggaggcatcggtagagcctgcacctaagtccagaattgccagtggacgtgtggttccaggggtagtcaaggccccctgaatggcggcttctgcttctgcgcctccgacctgaacatcaacatgcagtttttgcttaatttcactggcgatcattgccatttgcagacggtcggatttcaccatagaggcaatacccacagcctgttccagtgaaaattcacctgccagaccgccggttacgctgacggggacagaggtatctatcgccagcaaatcctgaataaaaatttcgttgctgggtttgttggtcagttccgccatggtctggcgaacatgttccagcattccgccgatgttggtgcctggttctcccgtcacgttttccagttttgggcactcaccgaccactttcataatggcatcggcaccagcagctacatcaacgcgcgttgtgcgcccggcagaaagcagttcgatatttccggcgggtatcgaacgggctttaacgtcgccagaaggcgttttcacgaccactgctgaacggttgccgattagcgcccgcgcgacaggaacaatatttttagtctcttcagcattgagggcgaaaacggtggcaatcccatacgggttagacagggtttcgataactttcccgggaacggcaacttcaattgcagccagcatgccgagcggaatacgatcgatgtagaggacttcatcaacaataggtacagcaatttccaggcggttactgaccagcacgccatcgtcgccttgcagaataacgccagtcagctgatatccggcacgtacggaggcgtttatcatcgtcgcgatatcggcaaaatcaaatgccgatgacaccaccaggatgtaaggtgtgtccgccggacgtgttaataactcttgtggagtgatggtgagccctacgcccagccccactccgcccggagttttcgggttgtgaccgatcatggttgattcggtgatgatagtttcagtgatggtttccatcgccacatcaccaataaccggagttgcttcgttgatacgaataagcgaaatatcgctaacattgatgccgacttttttcgttgcctgtgcgagcgcctcctgaataccatggacgttacgcaacgtacctttaattccggtggtttccgccagggcgctactcacgaacgacaactctccagttgcactgagcgttgccagcgcaatctctgttgatgagttgccgatatcaatgcctgctatatatcgcatagttcgtccttaatcgtcgcctttcagttttttgcgctcgacataaagctccgcagcttcacggacaaatgcagcacaaattttggcctgataacgccgttcaagatcgtcagcaatggcaataagttcttgcttggttgaacgataagggcgtaacgcattgtagatttcgaggatacgatcatccggtactgaggtaagctcagcggcgcgttcaaaattcatcgccagacgatcgcgaccagcatctctggcaatcgcagcctgaatacgcaatgtttcaggggtaatgcgcatatcctgggcggtgacgttatcgcttagcacattttccagagtgaaatcgtcgagcgttttattggttgctgttttaacccattccggatgtttatttgccagcggataatccgtcactttggcgctctgtattgacgcgctggggaccgcagaaacaggagctgcatcctgtaaactgttcatgcggttcaacacgtccctgaccatcgactcaattgcatcggtattcatgaaggtttcctttgttaaaacgtcacgcgcagttcttgcggttttttgccggtgaccacgtacttcgtctctttaatatgcaaaatggcagatttggcctggtatttcggccgcgccatttgatcgttgagggtcggcactggttgtggagactcacgcttcgcataacgcgcggcgtttttgccaatctgacgataagtatccagcgtcaacaaaggcgcttgtgggaaaagttccaggttagataagggaggaagaccttgctggtggataaccgttgtacctttcgactgaataccgatagcaatacctgaaccactaagacgatcgccttcgactgctacgaatgcgacatcggacgatttaaagcagcgaatcacacgggctttaatgccttcttcttcgataccggcaatcacttcgcgcaagatgtttttatgcggaataccaatgatattgacggtttgcgccaggccgaacgccgggcctacagcaataatgacttcatcttgctgagtgccttgttgggcttcgccaatttcggtcagaaaatttccggtatctggcgcggaagaggcagttgcagagacaggtgcgcgaaatgaaacgggcttgtcgctggtttgcatttctgccagcacgtcttcgataatctgacgcagtaatttttcgttaatttccatttctcacctttagtcaatttcgttgggatcaagtgcaccgggaatatttttgatctcttcccagcgttccccttgcaggcggtaacctgtagccggtccggcgtaatcattgacgtcattgaccgcagagagcacttgtccgtcatcgacgatgatggctgaggtatggagataatcgccggtcagttttgctttttgcatgttgagcatgtcctgggcgacatcggtaaaaccgccttgcgccagggctttcaccacttccaggctgttccggtttttattgataatctcctgggcgaacttgatgtcttccacaatattgcgctcaggcatatcttttgaaccgtgggcataggttgccgcttcgacttcttcatcggtaataggcggtagtcccataccggcaaagacagcctgtaaagcgcgagcggctttattgcggatagcgataacatcttcttcgcgtactggtcgcaggccgccatcaaccttcaggtcacgctgaatgacgttgtaatcatcgaagtcttcagcatcttcgtttgaaccagcaaacatgttgtcgtagttcggcacagcggaaaaaccggaagagataaagtcggtacctggcagaaactgcatcaggaaacgtgcggtacggcgcatatccgagtgggtaaaggtctggtcattactggaggcgcattccagatccagcgatgagcaaattaagttttccgctaatactgcgcggatgcctgatggcacagctgatggaacaccgatgcagcttaccgagccattctgcaggccctgaacgcctgcggctttggtgatgtaaatgcaacgagcctcgagataaagcattgatttgccttccgcgtaacccatctgtacttcagagccggagccggaagtaaagcgcatttttaagccgcgagacgcataggatgacgcgagaaatccttttgaccacggggtgtcatcgccatcggtgaaaacaggttctgtaccatagacagaaattgtttcggcgtaacaggtgtggcctaacataccgagtttcagttcggtggcttcttccagtgaacactgggtcaagacgcccggacgtcccacctgtgagccgaccagcagggcgatggcgttgaacggggcatagcgagcaacggcaacggtggtttcctgttcatcaaacccgcgccatgcgccttcagctgcgtcggcggcaatttgtaccgggttatctttaacgttggtgacgtgagcctgttgtgatggtgttcgacgggcgcgcattttctgcatcgccatcatcatctctaccacgttcatctgcgaaaccacttcgacgatttttgcaggcgtcattgctgtggtaaggggaacgatatcgctacgtttgacatttggatcgcacaacatattggcaagttttaccgaatccatcgcgatgacttcttcggcgcgcgcgagattgatgccgtagcgggcgataaagtggtcgatcaggtcaaactgattggcgggttttccatccagttcggtaacgacgccgttaacaattttgattgacggtttaggatcgttcgggctttccatcgcaatgaagccttcttcaatccactctttaacgaaaccgtcctggttgaccgggcgttttgccagtgcttcaaatcttttcgatctcataaatctgcctcagagaattcagatgtaggaagggcgatcgtttttcggtgtatcgccgagagtcgaaagcacggttttaccgatttcgcgtgcggagatgaccgcctggcggactgcgccggagtcacccgagataatcagaatgacttcgttgctgtagctggtgccttgagcgggggagctgtatgccacgacatccacattggcggacttcagcgcggtgtcggccatcagaacacccaccgcagccggagcgccgacaataacgccgcaagcccgtcccagtggagcgccaaacgctttttccagtgcatagctggcgcgggcggtgtattgcagttcaagatgcccggcttcgttggcatagacatcaccaaaggtccgatcgagttctttcagggcaacttcaataccgcgtttcacgtcggaaacatcgttgccacctaagaggatcaatgagccgtgtccggcaccgcctttagtatcgcgaggaagttcaatgctaataacttcagtgttggtggcttttaccgcttcatcagcggccataatgtgtggccctgcgccaatacgagcccccagaatgccaatggaacgatagcgtttttcaagtttcatcgcgtccaacagggcgctatcaacgttcgcaatgaccagacctacagtgtcgccaatagcggtgccaacaaattctgttaacgtgcagcttttttctgccatagccgtctctcgtatttgatgagtggttttcgggagaaccttatgcgctggcgtcgctacgcgagcgatgacctgcgccatgatctgttcgaccagttcattgctgctcatgggttaattccctttggtaagattttttcgacatcggtatgtgggcggggaataacgtgtacggcttttacttcgccgacgttacgcgcagctgcggcacccgcgtctgttgccgcttttaccgccccgacatcaccacgaacgatgacggtaaccagcccggaacctattttttcgtagccgaccagcaaaacatttgccgacttcaccatggcgtctgcggcctctatggcggcagttaagcctttggtttctaccattcctaacgcttcttgttgcataaaaacctcgcctggatttttttgacgatatgactataaaaaaaagcgaggaaaaagaatggctgacttaatcggctaatgagagaaattaatagagaacaaatattataaaattgcttttatgaactatatgttgttaatttattagttgttttgtggatatttcaatgtgaattaattgcgttggctagtgagtttaatcgcgagtaatatttcgttgagtttagttcgaggaaggaactgtgatatttgtttcaattttattatatcatgatggcaattttttattgtgaaagtttgacagtaattattactttcaacactgattaacgctgtgttgcatgattcggcaatgacaataatttgttatgttagcacgatttttacacgagtctgtcatgcatgttggcaatattttctgcagagcaattttttatagttgcgctcggtatacacaacaatcagcgcatagttggctgataaagaaaaactccgtaaagaaggtgtcactatgaatgattcactcaaggcgcaatgcgttgccgagtttttaggcaccggactgttcctcttttttggcattggttgtttgtgcgccctgaaagttgccggggcaagtctgggactgtgggaaatttgtatcatttgggggttagggatttcgcttgctgtttaccttacggcaggtatttccggcgctcatctcaacccggcagttaccattgctctgtggctgtttgcctctttcccagcccgtaaagtgctgccattttgtgtggcgcaattagcgggtgcttttggtggtgcgattctggcatattctctctacagcagtttatttaccgattttgaatctgctcacaatatggtgcgtggtagcgcagaaagtttacaactcgccagtatcttcagtacttatccggcagcggcgattaatgtatggcaagctgcgttggtcgaagtggtcataacgtccatgttaatggggttgattatggcgttgaccgatgacggtaatggcatacccaaaggaccacttgcgcctttacttattggtattctggttgctgttattggtgcttctaccggaccattaaccggttttgccatgaatccagcgcgtgattttggacctaagattttcacctggcttgcggggtggggagaaattgcgatgactggtggacgcaatattccttatttcattgtacccattattgcaccgatcattggggcatgtgttggtgcggcgatttatcgctatctcattgcaaagaatttacctgtcaatagtgtagcgcctaaagaaattagcgaataacgaaataatctggcagttataaacgtttatttttttactgtttgtgatctgctttccgaacttattaaaaagtctcccgcttcatggaggcttttgttattgtcctttgtgcttctcgtcagtaaatcatcagggatgatgtgaagattaaatgtaaaacaattgttttgctataacaataaattaactgggaggttttatcatgatttctgcggcgacacttaattcagaactcattaataaaatcgcgcaggattttgcgcaggcgaccagccttgcggttgtcgtggtcaatattcacggcgatgaaatttccgagctgtttaacttcactccattttgtcagatgatgcggcaacaccctcagctaagcactcgatgtcgcatgagcgatcgttgtgggggcctggaagcctctaaatccgatcagccttgtatttatcgctgtcatgccggattaaccgatttctctattccactggtaatcgccgggcatttagttggttttgtattgtgcgggcaagttcgtctgcgtaatgatgatgtcgatttggtcgatattctgaatgtcgatgattgctggcaggcagatcccgaattacttaatgaatttcgcaaagtccctgagatggattactcaagagttatggcctctgctgatttgttgaagttgattgtggaaaattgcctcaaaaaacaactcaattttgttgttattaaagagaacaaatttcagtcagattcggtgcgccagactcgtgcgcctaatccccacgacaataaaatgaaaaaagctttacgctatattgatgcgcatttatcagacgatttgcgtctggaagatgtcgcctcgcacgtttatctaagcccttattatttcagcaagttatttaagaaataccatgggattgggtttaatgcgtgggtaaaccaacaacggatggccagcgctcgtgagttactgtgccatagtgactggagcatcgccagcattgcgcgtaatttaggtttttcgcaaaccagttatttttgcaaagttttccgtcagacttatcaggttacgccgcaggtgtatcggcagcaagtgaatgaaaatgcggcgatggaaacggtatagagtaaatgccccaaaaaaagaggacggtttaaataaactctgcaatgaataattaacgttatttacctgttatgggaaaagtgaaatcagctcataacatacgctgacaggtgtggcacatttgtgcctgggaagagggtgaaaatccctcgcagcccccgctgctgtaatgctgacaaacccgaaaatgccactgatcgcgagattgggaaggtcgggagaggatgacgctaagccagaagaccagccagtcagccaataccaacaacttcggtgggaagtgggttgcccggaagcgtccggtagagtaccggcgcgtctttatacccctaccaccctgaaaggatcagggtatggcggcatcatttagttctttcatcgcagtgccgacaggcaccagggctgcacttaaggtgtggcaatcttgtttcatggctcatcaaccagaccgccattacaggaaactaagtggagggcgagaggcatgaaaacgataaaacccgaatcgatagctcttttttgcctcttatctggagatgtggatctggcgaaacatctggctgaaatattgccaataagctgttttgttggtgaggactggcagcaagatttccagcctcttgatggtgggcctgtacaatcgttatcagatgcgtatagcgattattcagtgctgctattgatagcagctgaaagcgagatatccgtaccagaatggctcgctcattctgaaggaacgacggtaattgtgattgcagaacacaatgcccgtttgctgactggtccggctggtggggctgtggcattgatccattatctgaatgaaatctgtcattccagagaaaccgctgtcaatgacgcattttgtcggacgttaacacgaggaagtctggctatcccgcaatgccatcttctttcgtaatggattgagaatgctggatttttaattatattacgcgcagtattaatcgcgtaaatgttttgcggtcagcaacggtggggatccattgttctgttcaatgaataccatcatacaattgaatcaggagtcggtatgatgattttggtgacggggggcgcacggagcgggaagagtcgccatgcagaggcgcttattggggactcttcacaggttctgtatatcgccacctcacaaatccttgatgatgagatggctgcacggatagaacatcatcggcaaggccgcccggcgcactggcacacagtggagcgctggcaacatcttgatgaattaattcatgcagacattaacccgcatgaggctgtgttgctggaatgcgttaccacaatggtgactaatctgttgtttgattatggcggcgataaagaccctgatgaatgggattatcaggcgatggaacaggcgattaatgctgagattcagtcgttgattgctgcctgccaacgttgccccgcgaagattgtattagtgactaacgaagtgggaatggggattgtgccggagagtcgtctggcacgacattttcgtgatattgccgggcgggtcaatcagcagctggccgctgcggcaaatgaagtgtggctggtggtttcgggtattggagtaaaaatcaaatgagtaaattattttgggcgatgctctcttttattacgcgtctgcctgtgccgcgtcgctggtcccagggactggatttcgagcattattctcgcggtattattacttttcctttaattggtttattgcttggcgcgattagcgggctggtcttcatggcgttgcaggcatggtttggcgtaccactggcggcactgtttagcgtgctggtgctggcgcttatgaccggaggattccacctggacggcctcgccgatacctgtgatggcgtattttctgcacgtagccgcgatcgcatgttggaaatcatgcgtgatagccgtttaggtacccacggcggtctggcattgatttttgttgtactggcaaagattttggtgttaagcgagttggctttgcgtggcgaaccgatccttgcatcgctggcggcagcatgcgcggtcagccgcgggactgccgcattattgatgtatcgtcatcgttatgcccgggaagaagggcttggcaatgtgttcattggcaaaattgatgggcgacaaacctgcgtcacactcggtttagccgctatttttgctgctgtattattgccaggtatgcatggtgtggctgctatggtggtgacgatggtggcgattttcatcctcggtcagcttctcaaacgtacgctgggcgggcaaaccggcgatacgctgggagcagccatagagcttggtgaactggtcttcctgctggcactgctataaagagacgtgacatgcaaacacttgccgatttactgaatacgatccctgccatcgatcctgccgctatgtcgcgtgcacaacggcatatcgacgggttactcaaacctgttggtagcctgggaaggctggaggcgcttgccatacaactggcgggaatgccggggttgaatggcataccgcatgtgggcaaaaaagcggtactggttatgtgtgccgatcacggcgtctgggaggaaggggtcgctatttccccaaaagaagtgacagccattcaggctgaaaatatgacccgcggaacaaccggcgtgtgtgtgctggcagcacaagcgggcgctaacgtccacgtaattgatgttggtattgatactgctgagcctatccccgggcttatcaacatgcgtgtcgcacgaggtagcggcaatattgcttcagctccggcaatgagtcgccgtcaggctgaaaagttgcttttggacgtcatatgttatacgcgggagctggcaaaaaacggtgtcacgctgtttggtgtaggtgaactggggatggcaaacacgacaccggcagcggcaatagtcagcacaatcactggccgggatcctgaagaagtggttgggattggcgcaaacctgccgacagataaactggttaataaaattgatgttgtgcgacgggcgattatgttgaatcaaccaaatccgcaggatggcgttgatgtccttgcaaaagtgggtggatttgatttggtcggaatggctggcgtgatgttaggcgctgcgtcctgcggtttaccggtgttgctggatggatttctttcttatgctgctgcgctcgcagcctgccagatgtctcctgcaatcaaaccgtatctcattccttctcacctgtcggcagaaaaaggggcgcgtatagcgctgtcgcatttggggctggagccttatctcaatatggagatgcgtttaggtgaggggagtggcgcagctctggcgatgcccatcatcgaagcagcctgtgcgatatacaacaacatgggcgaacttgctgccagtaatattgttctaccggggaatacgacttctgatttgaacagttaaaaacgaaaagtctgataaaagctatacttatcggatagtattcgcgacttaggaaagggacatgatgcgtcgtgtaaatattctttgctcatttgctctgctttttgccagccatactagcctggcggtaacttatccattacctccagagggtagccgtttagtggggcagtcgtttactgtaactgttcctgatcacaatacccagccgctggagacttttgccgcacaatacgggcaagggttaagtaacatgctggaagcgaatccgggcgctgatgtttttttgccgaagtcaggttcgcaactcaccattccgcagcaactgattttgcccgccactgttcgtaaagggattgtggttaacgtcgctgagatgcgtctttattactacccaccagacagtaatactgtggaagtctttcctattggtatcggccaggctgggcgagaaaccccgcgtaactgggtgactaccgttgaacgtaaacaagaagcaccaacctggacgccaacgccgaacacccggcgcgaatatgcgaaacgaggggagagtttgcccgcatttgttcctgcggggcctgataatcccatggggctgtacgcgatttatattggcaggctatatgccatccacggtaccaatgccaattttggtattgggctccgggtaagtcagggctgtattcgtctgcgcaatgacgatatcaaatatctgtttgataatgttcctataggtactcgtgtgcaaattattgatcagccaatgaaatacacaacggaaccggatggttcaaagtggctggaagttcatgagccgctgtcgcgcaatcgtgctgaatatgagtctgaccgaaaagtgccattgccggtaaccccatctttgcgggcgtttatcaacgggcaagaagttgatgtgaatcgcgcaaatgctgcgttgcaacgtcgatcgggaatgcctatgcaaattagttctggttcaagacagatgttttaagagcgttggtaattagaaagcaaaaagcctgcttgaaagcaggcttttttgaatttggctcctctgactgggatcgcttttgcctttaagtggctaataagtaagctaaacctgaattgcgatgctgtcaagaccaccaaaatgaccaccaataggcgaaggttacataaatctaaaaagctgcgcggaatagtagatcactttgagtgaactcagcccggattgtgcgatctgatcatcgccaaaccaaccaatatcactgaccggactgagtgatgccgatcatagcaccaattccccgtgacgaacgacgcctgatgcagaaagcgatccataaaacgcacgataaaaattatgcccgtcggctgactgccatgctgatgatgcaccgcggctgtcgcgtcagcgacgttgccagaacgctttgctgtgcccgttcctccgtcggccgctggattaactggttcacgctgtcgggtgttgcaggactgaaatcattacctgccgggtgtgcccgtcgctggccttttgagcatatctgcatgttattacgtgagctggtaaaacatgctcccggcgattttggctaccagcgatcacgctggagctcagagcttctggcaataaaaatcaatgagataactgggtgtcagttacacgggtgcagcgcatggcgcgggtgcatcattatgggttgcgggatcggctggtgcgtgggggcgaagatgtgcggtatgaggccaggccgctgatgggtataaataatgaaacaatggggaagattgaataaatcataattaataacttgattttgtgatggcaatagcttttatttaattgagatatatcccattgctatcatcggtacgatgtaaaatttgatttttcatcgtagtcttgttcttagtattaaaaaggatttatatgtctgaagataacgaaatttcccaaaatgaaaccactccagaagttgcatctgaaacaacgcctgtagttaaagtaaggaagcctagaaaaaaagcgaccaaaccaaagcgtgacttccctcaatactctctagaagattgtagaaaaatagctgactgtctgaaggaatttaacgccggtaacccatgggcaccaggtgaagttgctaaagcactgggtttaggtaaagtgccaattttttctacatgactgcgtctgctcgagattacggcataaccgtgggtactcgcgacacaagcaaaattgaacttacggaattagggaagagtttagtatatcctaaatcacaggaggaagaaggcaatgcaatattaagtagcttcttaaatatagacttatttaagaaagtatatgattactatcaaggtggtaacctacctgagattgaatatttaaagaatactctaaaaactgaattcggtatagatgatcaattacaagacgacttttataacttatatcaacaaaacctcaaatacgttcgagaaaaagtcgctagagaagatagcattagtactaactcagttaatgacaaaactgccacagctagtagttccattatgctcggtgaatctcaagggcaaagtaaacttattgcatttgttgctatgcctttttcagaaaaaacgtctaactacccgcatggttattttgatgaagtacttaaacatctcattacgccttctgcggtgaaggctggatttaatgctaagacggcaaaaaaagcagggagtgaagttattcaatctacgattgtcaacgatcttgatgctgctgatcttgtgatagttgatctaactgaacacaatccaaatgtgctttttgaattaggtatgaggattgcctttagtaaacctgtctgtttgatcagagcaaaaggtactgcacctatatttgatatagaccacatgttaagagtctatgattataatccttgcttatggccttctacgctagaaagcgatattccacaattgtcagagcatataaaagaaacatggataaataggagagagcgttcatacctcgatattcttagagaaaataaaagctaaatagttgcgcggaataacgctactcttttgccagcccatgttgacctccggaaaacgggctggcggtttccataaaatggtgaactttttttagcaactgccacattgaacggcactgatgattccgggttatcgtgtcatgtagcgcctgtcataaccgctcaacgtggttcacagtaaacatcccgtataaccgggtcacggagatcagtcaggggaaatggggctgaaattaatctctgtttgttgggcaatacgccgttcgccacagcgataaacagatggagcgagctatgtcggcatatgggctaattgcagggccagttgattaataacaaaaatcccgcgtaagtttccttaagcgggattttctaaatttggctcccctgactgggatcgccattgccagtaactggctaataagtaagctaaacctgaattgctagtccgtcaagaccaccagaatgaccaccattaaacgctgtactgtggatcacgtggatgtattgctctgtgaattcacggagctaaattgatataaaaaattagtcgaatattactaacatcatggccacaatgatcattgtggctgattgtttatggtatgagatttttaattatgacataggtagtgttaataagttcttgctgttttttaaaacttcctgttcattatagattcaatttcacttataagaaatacgcatttctctaaaaaaataggattaatgcatttgtattttttatggaatattacgaaggaaagcagataagaacgatatcccaagagtttatttttcagttgcgatgagtagaacttggcttcaaatttttctttattttttttatatataaatcttttgagttttaggttaaatactttaatgcatatatgctttgaagagctacctttcttgatttcatatagtgctttatataaggggtttaattttgaagacgacaatctaatatttccactgctgttatcttttaaaatattttcaatgacgtatccacctaaagaaatagtcccttctttatataaatacttcgatttatttaacttgaatttattaatggagagaatggatgaaatctcatttataaaaaaagtgctgcttaatatattgttttctttttttgttgagaacaaaagatcatctgcatatcgtgtataagtaattttattcttatcacaaaatttttgtattaaaatgtcaatttttctaaaaataatattagatattgatggggaagatttaaatcccatcggaatgaatgttttttcgaccccgtctaactccgcagtcagagtcacactagccatgaatgcatctaataaggattgtttctcttttaccaaaaactcatcggaaaagtataccgaaaaagtatcacgtacaatatttacgtctatgctatgaaagaatgaaacaatgtcaagatgacaatatttgacattttgggtatgaggctctaaataatgcaagtatgagcgctcttttctgaatgcaaaactcgatgcacttaaaggtatatttttaagtaagaatttttcaattctggtttgaatagagtagtgtggggatgagtgagctagagaatagaatgttttatttttgttactgattgttgatacttgattcttggcaattggtggtataactccccctgcctcgaattcattttgaaatgatgttttaataaaaatgtcagtatagaaatttttatcaatcttgcttattttttctttcataaagcttcttctccgataccaagaccatctttacaccccgtgaggcttaaagcggccatcgcgacaattggcggcggcaaactagtgtttgcaggggctaggaacgacaatcgttcagtgaaactcccctatatctatcgaagaagaagcttgctctattatagatataatttcagggaaaaggaagcgtaaattctcggctatcttatcagcattttcttgctctaacttagctatcgtaaaatccaaaaaactggtaacccagccactagtttttgtggtataggggagtaagaatttaagctcattgcttttatatttctttattgtggctgtaatagatgggtctattctttgacagctttttttcagattcatttctaaacttataagtgtggcagtttttcctccaaaaagaagtctaaatagggttgtaatttctttattgtttttaaaatctcctttaatgctttttttaattaaaaaaagagccctttttttaaccttgaataccagcttttgctccactggatctaatatacttaaatgagttgagagaacaaaagccgaatttaatatacttatagctccatctttaagattgtacgttctcattaagccagcaaacatttttttagggttttcattattgacgtctagctggttaaaaacgatatgacaaatccatctgtaaaagtattttaaagaatgctcatttattaatgcaccctctattgtagttgtcatataattaaggttaaatgattttaacagtttattgaaatccctcacaaaattttcaattttaaatgttttgaaaaacaagccatcaaccgacatttccttcttagacttatccgctcttattatttcctttgcgctgtcaattttttttattaaggatggattataaaactttaaactgccttttcgtattagtttattaactagagaaacatcaccatccagacttaatatttcatttttatagtcaagcttaatcaccttgtctatatctttaacaattaaaaaaggaattgctgcttgagaataagttgggtttatatttctcaacataacatcatcactggcgtatatgtcaatcctgcctaaatcaggataaattctagctaaagaactattttggaagacttccatttcagtggaaccttctacgaaaagaatatactcactgaaaaaaagtctagcttcattatcgctaaacatatttataaaacgcaaatcactatattgtgagtttaatttagatatctttgtggagtgtttattctttttagaaaaatgcaaaatctgctgatctgttgaaaaaagtttaatagtttgctttaaaatatttggtgcatgggtgctgaaaattaaacaaggataaggtgttgagtattttcctgattccttttcgggaacgctttttttatatctattataagttgtgtgaattgttgtaataaattgctcgccaagttttggatgtagtcctatctcgggttcgtctatatatatggtaggtgttatgaactcggttcgtgataacgaaatgagcaacttaataattgtttcaatatatttatgtgaatttgttccatcagactgatgaaggatatcttcacctgagttcgtgaaaatatgacctttcaatgctatcttaatataattaattactttctctttataggtgtatggttttgtgtcaattacatcagtaatgcgagtgatgtattttttgtagtcgccatctctagatgaaatattttcatctaaaaatttcaggatttcatcttcgcttattttctgaaagttgaaggagttaatgctacttattattctccatatgtcttcccagttgtataaatccattctacgtgtgtctatataaaaaaaagggaagataattttaattagggataaaagttttttatctttcgtagaccatgatattgagtcatcatttgatattgtaagtgttaaggaatattcgctattttgtttttttctttcgggtgcgaaaagtgcggtgaatttatttttatttggttctttaaaaagagtgttgtatatatgtttatgaaatcgagagttattattagtgctggttactattttctttatccgggttgtatcatatgtaattgttattattccagagggcgtgtaattcgaatttagagtaagaggaatgctccgttgctcgtctaatttttcataaaagtatttaaatacttttaaaagatttgattttccagagttatttctaccaataatcaaattaaaatcttcaaagctatcaatatatacgtcatcaaaggagagtatgtttttaatccgtatactttttattcccataagtaatatacctgcggtattatcatgcatatgtgtataagtattaacttaattgatttttgaaaaaataattcagttaataggtgaatagaaccccctctgttataaataagtcttattagcaagagagggagagattttacgttggtaatagatataacaactaatttttatataagtacgctaccgcccatagaccttattgttaatggccatgaatataataattaattttcttattgtaccatgttatcgctaatgatttcaaccaaatttttaatatatatttgattgtatatataacaccgatagtatctttgtgtttgttctacataattactaaaaaaagcaaaacttcaaagtgaagagttttttattattatctataaaggatgaacaaaactataagaccattttgaatttactatagtaaatttttgggggctccgtatcattgaggtattattaaatatggtcgaattacgatgttaatccaaaaataacttttaatgatggcggtgtatgtttctaataaccaatcgctctatgatattactcctgtttgtcgttaaaagcaggctaacatcttagatatgaactaacgcctctagatcctaccacaacctatttcaccacagcggagcaaggggctccatgtccagctatacagaggcagattttttctcctgtatgctttccattttccatatcagcttctggtaaatcgtggattgaccccacgatagtagatatttcctgccctcataactggacctgttcgaagtccttcgggatgaaatggcttagatggctgtggtgccgttccaggttgtagaagacctcaatgtaatcgagtatatcagcgcatacagcaccagctctcataaaaatattggttttattgccagcccttcacgttgtggacatagaggtcgataaccgactctttaacgtgtcactgcatcccgctacattacatagatgcttgagacgggcagaatgatctggcccagagcttcgccaacacttaaaatccaacatctgcattatgaggaaaagtggctccccatctaataggctgtagcccagaggcggacggaccagccggtattttatctggatgaagccgatatcgatctgaatccgaaaattggcgtggactggatgcgcaaaggataacagaagcgtattacgacgccgggacagaaccaaaaacattatgtggcggtatgatgcattcggatatgaggcaagtccattacgtcggtggcgtaccgcgccgacatgtacagaaaggccttaaactcgaccaaaaagatttatccttaagaaattgtggaaaatggcttatcagtgctatttcataataaactgccaaggaaaaagagagaataagatatgccacacgctattatgccttgggctcaaattgcacctaactatcatcggaatacgatattgttgggtaatggtgcaagcattgctgtttcaccggtccttgactacggttctctactggcttacgcccacagggcaggtctgcttacacatgatatgaatcgactcttccaatttttcagaacatccgatttcgagatgattcttcggctagtttggcaggcatccaacgtaaacagatcacttcaaataccagacaatcgcacacatcaagcctacctgaatgtcagaaattgtttgattcaggccgttcgtgatatacaccctgaatatgagcaagttagcgataaattgcctaatatgtaccagttcctcaaagggttcgataccgttttatcgttgaattacgacttgttgatctactggacgatgacctatggattcgacatccaagatggtcatttattcaaggattgtttcttgtggaacggcatcttcgacgatgcttggtggagatttcgtgatacttttagagagcgtactaacaccttggttttctacccgcatggaagcttggccctgtgcagaaatgttgtggagcaggagttcaagatccacaacgctggagaaggcttgcttgaggcaattcttgaagagtggcgcagcgagcaagcggtgccgctgtttgttagcgaaggaacgatgcagcagaaagtatcttctatccagaatagctactatctgtccaccgtgtaccgggaggtacttacgtcgcagcgaccctccttaacgatacttggttgggggcttggagaacatgaccgtcatattctgaagcggatgcgcggaaccggcatccaacgtgtagcggtttccgtttatcgctggaatcaggtctattgcaaccatgcgtatcaggttattcaggacgatctagggcctgttcgtgttgatttttttgacagtgaaagtcctggatgttgggttcatccggtgcagccaattttgccccgattttagacaactcgcgggattaacgtggttgcctgagcgaggacagctacggagattgaaactgggcgcggcgaatcacaacatcgcccagtttttttaaagccaccccgtgggcaatctgacgtcgggccggaggtgtcaggatacggaaaactggctaagcctgtcagggataagcgaatagcaaatctggagcaaccagacccgcgaaggggaggtacatatactattcgataaaaaacgctggatcgtcaccaagtcattggtgacttcccatttgtatacacatttattgtgcagggtcggctataaaagggaacaaaccgtaacggccatgatgcggattcttgccaaacataagagactgctcacgcttcatgattgcatcaggcgggtcggtgttctcaacaacgatgacttgggtgtcctcaggcagcgcttcaaggtacgcgtaaaactgatctttaaggtcagtaccggtcaaatcatattctgttccatctggctctctgtatgccagcaatggagaatcgagtacaacgaatcccgtgtgtggtgtgtggcgctcacggcagaaagcaagcagcccgagggtgaaagctgcatgcgtaatggcgcgaaggcccttaccaaaagcactacgcgactttccagcaattacaagatctcgagacttggaatcgaagtacacatccccaacctctgggaagtgccaaccagtcagtatgccttcaacagtcttagcaaaactatgggccacagtgcttgagagatctgcgttagtaaccaccccagccttctcgtcctcagtgcccttctcaagatcagcccgacggcgctccatgtcttgaacagtggcatagagtgccagcgcttcgcgtacctcggcccgcttgtcggcaaagtctgaataggacttgcgaagggtcgagagcttgggagcgaggaattcttcaactgactccgaaatcgactctaattctcgaacaacagtgggtattctgcgatcaaagttggcgccttcgcgctcaaggctttggacggtagctacaagttccgtgcgcaaaacttcgatcttggcaatctccacacgtgcagcctgaacgacggcatcagtatctccattacacccagtatcggggggatgatgatcgggggccgctccgcaaagaggacaatgcccggcactcagtacgctaaagagcgtcccgccttcttcaatggcacgtagcctttcaatatcggacaagtagtgtctatcaagcagcctgaatcgctcaagcatcgcacttacctctgcacgtcgctctcggctttcttccagttttttgcgtaattctcgtcgcttcccggcagcctcctgaaactcatcttcggtggtgtttacctgggccgcctgttgacgaagtgaggtgttaatcttctctagctgctccttgagttccttaggactctttgtcaactccttgagccggtcaccatagtcttcaagaagctgatcgagaagacgcaattgtgccttgcgcgataactcttccggctcactcttattactggtggcgaccaatgcggagtcgtctgctccggttaaaagtaacttgaatgtggccaagttcggcgtgttggcggtgggattgccatcaataagcggtgagctttgttgtgtgatctccgtctcatcgacgatcatcaaacgcgcaatgttgcgaaagcttaaactgagggtttcgttccgggaatttttgcgaacacgctttccaccaaggctacatagatccagcaagaatgatgaaaggttcgtattgttcttatcgctgtgtttttcgtcaagctgcgtatacggaatttcgtttgttggtggcgtctggtgcaagtcttcgtagagccgaaaaccaccgccatctatgctgcgccagagtgtaaatgacttcccatcaagggtttcaagccccaatagaacaaggtcgtagccaacgcgctcagggatatcacgcagaggcggctttccaccgagcatgaagtcgatggcttcgacaatgaaagattttccagtgtttgatgcgccgtaaatgacattgaggccagtaccgaaggtcactgtagcgggtggcttttgtggcccaaaaaaaccgagaaagcgcaagcgtaagccgggagttactgtcgtcatgcatcacctcctaagctttgctcaatgctctgaaactgttcgacccatttatcgaagaaacggcgcatcatggctttgaactgttcatccgtcagatcaccaatagtttcgacaagccatacagcgcgatccttcagggacagcaaatagttggaagatactgatgacaggaacgttgcagcattttcacccgcgccgtacttgattccctcggatgtgacttcgcgctcaactaggtcacgggtcatcatcagaagcagtgattgctcaactaacttgcggcgcacgagcaattcagcagagcgcattggcgtcggtgggtgcaaattgtctggtccaccaatatcgcccgtgtgaacaagaaggtagtcaaaggccacaagccgctggaggtcgtaggtttgcggataggcagcacccagaatcgagaccgcacgtatacccgcctcaagtgggctattgaaggtaattggcttatgttcttggctcatgatcgtgtccaccgaaggcgctcttcgttcacaagttggtggcagattccgtctctatccttggggttagtacaaatgatgagggcgtttgccgtaatttgcatgtcgcgggcagccttggtgacagcgcagaccttttcgtagccgtcagcatggttcccgtcatgtgtatcaataacgccatcatgaatgtcatccagcaaagcttcgaacgtgcctggcgggacactatcacgtgcgaagacgcgcagtgactcagcctcatagaacgcctcgcgctggcgacggaaatgatccttgagtttcggcaagggcaaggccgaagggtcagtcactattgttcctgtgtgttcgctgtatgcgccgaacaactgcgtcacatagcggctctcggtggcggcaacttcttggggcggcttttcagatgcaggccgcgttggtagtccaccaccaaagcgcgctgtgtgaaccggtgtggctctgtgatcgtcaacaagctgaagcgcagtcttggcgtcgaagatggtaaaatcgaatgagtctacataggcacgaagcttcgcgtcgagtaacacttcttgtgtgctagtgattgcatttttcacatgcttatcccagttagctaacaattcctcacgcaacttcgtgtcattcgaaaataggcggctaagcgacgtaccagcacctcgtggcgaaacaaagtagtagcgacgagggaccgtatattcacctttgtacgagtaccagatgatcttcccgaactcaacccaaacatcactaggcctgatggcattgccgtagtgcttgcattggaaattgtcccaaacccccagcaggcgttcatcaccaacgaacccggcgacatcaatacccatatcaccagcaccagagaaacgcaggacgtgttcatacttcgtcgtgaggcagtaataagcccattcctcgacgaatccctcccactcgtctggtgagtaggtcagtagtctttgctgcggtggaaaaatggggccgttcgccacctgagctgccgtaacagcggttgctgggctcggcggcttattgatgtccatccaactcgcagtcataacgcaccttgtgcttggctatcgtgtgggcagaaatacgggtttttgtgtatctgcgcagcctggactttctttgtgaagaactctgaaaggtcgtcttgctgctcaagcagacggacgatctcatgaagcgtggataggactacaactttgtgttgcagaaattcacgtgccgtaagaatggctggttctgtatagtcactggcagaaatgaagatacctcgaacctcggcacgcgacatgaggcgaacaagatgctctgaaatctcaggcttacccaccggattgcgataccatttcatttcaacgaaatacagaacaccactgagttcaatgatcccatcaatctgctcgacgatcccttcaccagcctcaccaaccaaatgaaaggatttacgaatgagaacaccgtaggcttgaaaaagattgttgagagccgtctccagcaattttcctctttcctgtgcagtcgcagtagtgccaaataatttatataaaccctgcttggcattctcgattctataactacgatcacgtttttctgctgcgatccgctgtgactcagcgaggcgggtttgccgttcttcttcgcgggcattgttcatgcgcgtgaaagcgtctttttggttgacgacttcgcggatactggcgacaagacctttggccttaagttggtctgcgggccagcacgaatcaaagttcgcaaagtccaccacgcgccgcagcacctcgcgccgttcacggagagcgtgttcccccttcgcgttgaggcgttcaagtaccgtgcgaaccatctggtacttgttgacatcctttggtgcagccctcaagtgaactgcaatgtcagaagttatgttgtcaggtactcctgcgccccggaagaaaaccagcacatcctgcttagagcgattgagcaacggcacaacatccaccaggagattgaacagctccggtggatagtgaaatatgatgtctgaaggtgcatcattcatgcgctacttccctccaaatacactcatcaatgtaagcccttccgtcataaatcttcccaattcaggcttcgtatgcttgttaatcttacaatagtaaacagttaggccagtagggagcgatctgatagccattcctgattcagtttcgacaaactccaaatcgtacagtgcctacaagtgcatccagaactgcgagtaatcgctgaaccaatgagcaagccgtagtgcttagtcgctggtaatactgcgtttgccgatgatgatctgggtgttccattggctgggacaccaagttggcgcgctagctcaatcgttaacacaccaccagcatcatgccattgtgtgagaacttcatttgggtgacgggcagctgcggtcatattatgccacaaaaaggacaggctattactcaacggtaagggttttgaggatgtacgtcaatcgtacataaattgagtataatcaaatacaataaaagtaagcagcgcatacagtcggtattccaaagcgtagggaacatgctgccacggagaattcaacatagatcacagcaaaatgggggccgaagctccctgcgatcaaaataacccccattcagcgaaggacaccgtggactcacctccgaagtaaagtgagccaatgtacgcatgtcgactattcccaatccttttttaatctgcaccctcatcaccttgccagcatgactgggctcagagataccactcggatgattatttgcaagtatcaccgctgcagtgttaacccccaaaccatttcaccgctgcgaactaaggggcgctaagtccggctatgcaggggcatagtttttcctcctgtgtacttttcgttcttcatatcagcttccggttaatcgtttcccaacacaacccgtccagcaagggtaaatggcacgcatgctgcgcccttgctggacggaacgatgccgggaaagcgaaccgtcaggcgatacgaagacgaaaatcacacactgacggagaaaaaaccatgacgatttccctgcatacccagactagcgcccctaacatcacagcggcgaccagcgtatccccgctggacccgtcaggctcctcaaaaacgaaattttctaaaaccagagccgacatttatcagaccgttaccaacaacatcattgcagcacttgaaggcggtgtaaaaccgtggtcctgcccgtggcaacgcgtatccggcatatctggtctgccatcgaattacgccaccggcgtagcctacagcggtatgaacatcatgttactgtggtgcagcgcatctaagcagggtttcagcgattcacgctggatgacctacaaacaggcacaggtagcaggtggacaggttcgcaagggggaacatggtacaacagctattttttacaccacgctggagaaggaaaacgacgccggagaagttgaacatatcccgatgctgaaaaccttcaccgtgtttaacgttcagcaaatcgacggcctgtccctgacaactgaaactgtcagcccggaagcaacctttgacccgttgccgcaggctgagaacctgttgcggaagagtggcgcaaacatcatcgagaaaggacaaaacgcctttttcagcccatcaacagatgaagtctggctaccggagcgccatctgttttcggatgcggctaatttctacgctacaggtctgcatgagctggttcactggagtggtggcaaaaaacgtctgaaccgtgaaatgaaagggaagtttggcagtgcggattatgcagaggaagaactggtagcagagctgggaagtgcctttctgatggcggatcttgggattgagggagaggtacaacatggaagctatattgcttcctggctgaaagcgctaaaaaacgacaagcgttatattttcaaagcggccagcgcagcctctaaagcacatcgttacctgatggataaactctgagaccggaatcagacaccgcaagggaatgcggttacatggcttttaaccggcaacgctgcaaggcgcagactgaggcggaacgcagcacagcgagtaccgaacagtctgcggctcgcagtggaataaaaaatttccggcctggcggtatcgccgccaggccggtgaggccatcacgatggcctgagtaaaagcttacgtatagctgcctaatgacaggtgtttcagttcatcaaaggtataaatgcgaaacaccctacggtggcgttcttccagcgggatgtgctgatggttgatgatgacatgcctgatactgtcaaacagcagttcaagcgcacgcttcttctgtggatcgggcacaacataaaaaatgtaaatccagtacttgtttgttcgggccagcaggtggctggcgataatcgactggtagcgggctcgggttttcaggcggcgctcggtttcaatggcaataacgttaccgtcaggcagggtcagtaacccgtccgggcgatgttttacctgatactggctgagaaagctggcacggtcgccgttaatccatcccgaagcacctttcttctccagaataagcctggcggcctgattatcaagatggtgctccagtgtccagccggtgatttttgatggttcaaaccgcgcaggaaagattttatcattcggggttaagaccgccgccagcccgtcgctggtgatcccccataatgaaatcttgattgtccgtgattcaagcatatgcttctggattaaccccattcgctccatttttgcaagcagcgaataaagcgacttatgatctcggaagctaaataactgcatcagcgttttaaaatcactgtaggtttcttctttcaggaagttcagcagttgtcttattttctcgctgttgcgcgtctggcgctcgtgatatgacgaaatcagcataaccactccttaaaaatccagtggggagaagtgttcttcatcatcagattgggactttgccggttttacttcgctttcgtcgaagaaaagagccggatgggttgtcatcacatccggcatggctggtttatcatcctcgccaaaatccagcatgatcttcaccggggctgccgctgcggcaatatcaggggaaaccgagaagatttttagctgacgctttctgacctttatcggtgaaatcaaggaggcagaaggtagcgtttttgtcgtaaagataaagctgacaaaatcgggcaggttcaggatcatattgctgtcaataaagaaacgttcggcctggcggattgtgcgctcactgtcgatggtttctgtcagcatattatccgtcttagccttgcggagttcgtcatccaccagaatcgtgcctgacattcttgccacccagcctgccgtatccggatccataacccggtaaaccagtttgaatttggcattttcaacgaccgcaccgacaacggcgtcacctttcaaatctgccgggcagtcttttaaatcggcgatggactggtggtccataataatgtgtacgcctttatcccgcgccgcgcctaaaccttccagcgctggcctggataaatggtatttcagttcggaaagataaacagcaatggggcggggtacgtctgttacacggtcgcgcctttctgctaactggtaaaggcgaaccagcagcatgcgctgggcggtaataattttgctgtttcgcatggagccgactacataacagcagccgccctcatcaaatatgtgcttaagcgaaaagccttctggtgagttaatggcattgagtaatgccagttcctcaatcttcccaaagaacgctttgattttttcggcaataccctgaacgtaatcaccgttataaatatcacggagagttgccgatgggttatcactgacaaattgcgcggccatacgggcggcttttcggtcatcaatacgatagaagtccgattcctgccctttttctgccaggctgaaaccggcaacgaacaattcttccagttcatctggcgtaatatcttcaatcaggtttagctggtattgctgttttcgcaggtcaattaaggcaaagggttttcctgcatcctcgcaggctttgcggtaaaggtgtggtgcccattcatcgtctttggggtccataacaaaaacgccttcaccggcaataatactttgatatagcaatatcccggcagctacccctttaccggctccggtggtgccaataatatccgcgtgctgtttctgccagtcttttaacgggagatacattggttcgttctccctgtccatgccagtaaaaatgcctttattcaggtcgatataatccagcggatcataatgcagtgtttcgggcagcagggactttacggtgcggacatcggtgcgcaattcccgttcaagggtggtttttttaacaaggcgtttctttattttgtccagttccggcgtgaatatccggcgaagcataatatgaaaaataaccccggttacagtgaatgcaatccgtactgaccaagccagtaccgtattatcactgctgggtctgatcttatacaaccactgaaagggtccgataacgaccggagccagtgtgccggagagaaaacacagcagggaaaaagcgataatcagctttttccataacggggctttctgccgttcatcgcttttcatcgacgcaaaaaacggcatcgtcagccccgctaataacgccagcaccagttgttgctgttgcacaaaagcgagcagcgccagcatcccgttcactatcggcgacagtgaagcggcaagcttatttaaaatcatgatacctccctcgtcagctattcaccccataacatcgccccatcaattcgccccacggtgtcgggcgaaaaggcggggcgagcgtatggggtaaagaaggtggccgctgtgcggccatgtgcaggaaagcatgctttcctgcacgacacggcgtgcgccagtacatgcgggctggacgcccttattgcctgtcgcatgggggtaatgtcgcggctgaacgtcgcgtcaaaacccccggggtcaacggcggcacaccgtcgcacgctacgcgcgaccaacccctttaagacgcgcgtttagcctattttttcttcgcaagctcgaaaaaatgggaacgctgctttaaaggggttggtcgcgcctaatcggcatattccccgccggggcgggaaatatagcctggctgcgacggtgtgcggggcaagccccccacaaaaaccggcacgtgggcgtgccttattgctcgctggggcggcaaaatttttgcggctccccccggcccgcttcaattcgctggggcgaatgttcgcgggtggacgtggatcctgaaaattagcaatttctccgaaattgaattttctgtccacgttccacttcattatttttcgtcttaacaatttcttcgaaattgaagccaaaaataatgaagccttaaaaacccgccgcctgtcagcctgtgtgttgcacaatacatttttgttctgtgtgattacatctgttcgcggtatatttcagccctgcactccctttcagcttccagtgcttcactgtaggacgcatcatcaattttcgtgcctttgctttcggcatagcgtcgtaatttatttgcgtcagcttcattaagttctaaaagatgatcgcgcaaaagaccgataagcctgctttcgtatatctcataatacagcccacaaccactgtgggcttctttagataacgtgtcatatatcagggctaccgatatcctgtcctgattacgagaatgtatatttcggataaataagtcttctttttgcatgttgcaccttttacagtaaacagggggtgttatgcggattattactatcctctgaccttgccgaacttagatagtattttatttactgcctccgggtctgcgctgggacattcaccaagaaatgcttttctcgcattcaacgtatggttaggtaagaaaccatgtttattctttttgactatattaaagaaagccttttctgctgagcggcattcacttccaccactattacccgttgcttttccgtacatgcaaagaacaacttcgcacgggtcagcggcaaaggaataaattggggttcctgcggccatacataatacagccgccgcgataacggttttattcatggtgagtccttattaggttgtgttgcttaaattgattagcgagagaaataaatagtggtttctctgcacgtcagacaattaaagacaggctggtattcaataacaccttttgctccattctgccgaagccagtttttggcattaaagaaatcagtgccggattgtgcagtgacgacaattcgtgttgagtgggcgactgcgtaaaatacggctggagtccatattgtattgtattgtagaaactttgtgcgctgattgatgatgtccatttactgttaactgtcggggaagggaccataacgttattgtcgctccattgcggtaaactggtatttaatggggcggcggctttatcccaatctacaggaacgggaggcggtggcgatgaacatccggtaactattgctgccaacatgattactttaatttgttttatcatgctttcatttcctcaaaatactggtttcgatgaattggacggaaataaatgtcattcatacggcggacatttccgtctaaatcaatgctcacaatcacgtccaggctatccagaaccttacgtaacataaatgtataggggagctgggcgcactgtggattttcatagcaacgggtaataaacccatctatagcttctttcgctgatcctgcatgaatggaggtcatactcccttcatggccggaacctgttattttaaggaagtcccaggcttccgcaccgcgaacctctgttaataaaatgcggtcagggttcatacggtaattccagcgtaaaaggctcgccggggtaacgatagaacctttttcatctgatgattctgacggataaaaaagatggacgtagtttttatggataaagaacgtgatttccgggttgtcctcaattgttgatatccgaagatgtaccggaatataacctatcaacattttcatataggtagttttccctgtactggtttccccggcgaccgcgagagttttaccgtactcgacgcatttctccataaacaaaggaatgttttttgtattgtacaatgcaattaattcctcgtcgtgcgtctccgttttttcctcgcctgttacccggttataaaaccccgcatcgatatatgactgatgcgggatttgtacctttgatggcttacggatggtgatagacaccgtatcgcgctcacaggccggaggaacaatcacctggcaccgttcgccggattccagcgtggctgacagccccggcttaatatcttcgatattgtcgccgtggtgttttgccaggcaccgggcaaagttgtagcaatcctcatagttcaaaggaacggcatgttgctcccacacgccgttgatttttgtgtacagttcacctggacggttgacggcgatttccgtcaggccgggaagctccagaaagtcgccaaagaaacgttgtttatagcggtcgagggaaatattcttagcggtcatttttcaaccttagtgtatagatgttggaaaaatcaatatcctcgcctgtgatcagattgatgatctcgccctgattcttatggagcgttgggggaatattgatgctgttttccagagtggtacgagccatatctgccatagcctggcgactgttttccgtatagtccgtattgcggtcttttttacctgcgctgttggatgcccatgcggcaatatcggggatcatgccaaccattaatgcgccgccgaatcgctcccagaagtgcgaatctatccacccatcaacgccagcctcgcccagctcgccagccgcgctggtatcaaccaacgggatatcgagataaggtggctggcgggtgcgtagcttcgtcgcaatgatgaatgcccgcccttgcccgtgcctcataccttcttccgctatggcgcggtaaagtaatgatgcggtagtgcctttctctatcagcttcgtgttgccgctggcgctccagatgtcagtagtgaccgtacagcgaagtttccccgcccggtcagatacaaagcggcgatccagtgagcaggggatcgaggtattttccgggatgtacaggtcagggttatagggtatgcgccgtactggtgcggggctttgtccctgcgacggtgcggtggtattttgcggctggccgggaggtgtggccgcgctgctgtcctgttgtccggtggttgttgccgatgtcagcgtcatttcctgctgccgggtttttacctggttctgtgtggtggccgaaccatcacggcgaataaggaagctggctttgttgagttctggcggggcagccgcctgccctgttccccccgcgctgctctggccgttatcctgttgctctggctcttcttcggctgtatcgatggacataccgagatcgttacgctgccggtaatcggttttgttcgtctgcggggctgtgtcctgtttcttttcttccgtaggctgccacaggatattgcgataaacccagttaccaccccatgccaggaagataagcgcgaccgcgacaatggcaagaaaggcggttgctttgccccgtttgcgctttttcagcttgttaacggcgggttgtaccgggtctttctcttcgtcgtcctgcgcgttgagaagctctgcctccctttttacgcgggcttcccgctcaagcgtggcaatatcatcctcagcgtgtgccggggatgcctgcgcttcatccggcacaggcactttgttttcgtcgttcatctgcatgtttccttttataaaaatataaaactatttttatagattaattggattccggtttttccactctttccacctgccgggatacggtggaaccatcggcggcgtgtaccttgccaaatccgctattttccagacctacaacggcattaccggaacgcagtaccaggcgtggcgtcacctcctgaatcaccagtacggtgaagtcgcctttcttctggatactgctgttaaccgcatgctctttgccgttcagctctttggtgacagaaggaatggacttagacggggagaagcccacgaacgtaaagcggccatcgtcataagcaaagtcgggaactatgttgaaactgcctttgcccggatatttggtgtaactccagttgcggggcgtctgcgccgagttcagcgctttctggacgctggcctgttgctgtttctgctcccactcgcgctgtctggccgtcgcctcccggctcgctttgtcccgttcttcgcccggatagcgatagctcacctgaaaagcgggttgctgtgccgatttatcatcgatgacgttcagctcgacgttgtacaggcgcttactggtgacaaccagcatattggtatgccagtcccggctgttcggggggatcacgacctgcgttgtgttgccatcttctccgggcgctccctgcgtgagcgcaaccgggcgaacgtttacccggtttgcatccggcgttgcttcccacgcctcatcaaagccgggtttggcgcttatgaccgcctcatcgttatcaaataccagcgttgtcataaagccgggtttggtgttaacgacggtgacgttctgagggttatagataacctgctgaacacgggagtcatagcggcttgcctgtggtatggccgcaccccatgccgcgccgcacatcatcagtgccagtgcggtaaacgttaactttttcatcattcacctccccggatttcgcggtcggtctgccaactggtgacggtaaagccgaagtagttgatctcgcgttccgcatcgctcatgtccttgtcagggtctgaatggaatgtgaaccgggcatcccaatactcgttgcgggtgctgttatcagccagacggcggataatcttcttgtagcgaacagtggcgactttatcgggggctgttccatcggtgatctggttggacaggatctccactttcacggtgtgcgcaccgttcttataaaccttgtccggggcgttttttccggcgtaaagcgccagatagtcatcgtttacctggggagcgttgtagacctgtaccgtctcgtagtcgtcctgcaaagagggatagacataccgctcacgtactttgacgtagtttgcggccatcgccttttgataggcttctgttgcggtcaggctggttttcgatgtccgggtaacatgttccacccgtcctgtgtggttatccacggtatacagatcaacgtctgtctgttttagtggcaacatcacgaccacggcgacgagcgccagtaccgcaatcagcagacccacaccgccaacaacaaaaccggctttcgtggcgcgtttatcccggtcaatcatttgctgctcaaaggtgcgggattcagcaattaatttctgttcattcatgactgtttaactccgccataatttgagatgtgtttacgggttctcccttaccgctaaatgcagatggaagcgtgttctgggcgcagccagaaagcgcgcatagcaaagccagcgcaatcaagcgtttcatcaaatatttcctcaattgaattaaaaatatgaaaatataattatattttcataagttggcactttggggggatggactggagacgtcttagctattgaacttcttaactgcggattctctcgactgtgccagcctccgcgcttcgttccgggctatcatctgctcaatcgcgtatttacgcgctttagaagcgttatagcctaactcacctccaggcttgccgggcttacctgcattcgcatccttccagccctgaatgttgtcctgggtggaacgtttggtttctttaattgcacctccggctagcttcccggcaccaaaagcagcagcaccgatacctacagcggccagcccctgcatggatacggtagcactcgccccggccagtgctgcggccagttttgcggagagataaaccaatattgccgcacagatacccgcaagacagacttgtgctcctaattcaacaattgttgaactgtccgcgaccttcgttgccttggtaaggactaggtttaaataattcactacaattcttaaagaaagagctgaaagcataatggttaatatggctgcaaatatattttgtagccagttattgaacatggtgcggagaaaaccatacataaggcaaaaaataaatataggtgctgtaatactcagtaataagatcatgacttccgctatcatggaaacaaacgcggtgataatcattaagacgaatatcccaagccagacataaaattgagcagtcattccctcatcttttatataagtggaatcatccatgtcgtgtaatgttttacctaacacctttgctttattccataaggtgtctaatagctgccatatattatcactgccagaaaaaccctcctttattccgtttatggcatcaataacgccatcgaggtagccacctaaattagctacaaaggacaggatgatcgccatcctcatgatgtcccacatcgtgtcttccatcggcgtagagagcttaccagccagagtctggtatccacgccacatgatgtagatggtagctgacgctgctgccagccccatcatcatagaagagtacgacatcattaatccttttgtggcgtccgttattcctcctattaggtatttctcaaccccaacaaaaagaccgccactcatatattactcctctaaattatttaagtctggagttggtgcgtttagctgctttatttgatagtgggcttcatttgcattcttgcagttttcagtagcatcaccactcttttggcacttttcataaacgagttttaattcatcagggtgttccttataccattttgttgttttagcttcctccttgcatccaataacagaaaaacacagggtgagcgtcgaaattaaaataattttttttgataacataaaaacctcataaattattaaggtcagcagttggcgcgtttaactgctgttggttccactgtttaacgcgctccgcctcaagcactttttcgcgtttatctgctgctttcacactcatttcccactgagtggtaagcgtgttcagcatgacagattttagctgaatactgtttgcaaggtcttgagattctttcgaatctttggctagcgcaactctgttggagaggctgttgatttctcccagggcctggcttacctgattctggatctcgtcggtctgctcaagctggatagctttattgatgacctgttgtttgcacacgttggcataactctccgagcgttcggctttgcaggtatcaaaaattttatatttttcgtacagcgcatcgaactgcccggaggagccgccggagagaagcaaatcattcagagcctgtcccggcttgcgtagtttttcgagatcggctttcaggcttttggcttggtcaacaaagctggcgatatctcgaacacctgtggctgttgccagttggtctttataagctcgtatctggtctttgtagtgttgtgcggtctccatccattgcttcgcttctttctgccactggcggacattttccagtttggccgtggcatcaaatactaatatacctcccgcttgtgccagagggcttgcaagcgaacatgcgaaaattagcgcgtaaaagtgagttttcatcctatatctcctttggaatcagagtgctttagccaggtaggtatcgagccattcatgaggctgcattccttcccggtaaatcgattcgaatatttcgaggttgggggcatcgccgctcatgactttggtatatctgccgatacccgacaggtctagcgtgacacgagcggcaaaacgtttggtatcgccgcgcttgaactgatttttcaccacaacatactggcgggcttgcgggtcaagccctttcaccacgtcgaacacttccggttcaaacttcatgtcgtcaacataatgtgcgcggtcggcgttggggttcgccgccagaatctgtgtcccgcactgctcaatcactgccggggcgatatcatctttgatgatctcagccggggattgagtgccgacgaccagcatcccgttcagcttacggatggttttcagcttgttataagcaaagtccttaaacaccgggtcgcgtaaccacttccagaattcatccatgaaaatgaccaggcgtcgcccgtcaagcaggctggtaatgcggtacagcagataaaacgagattggcgcacatacgcttgcatcgtccaggaactccgttccgtcgatgccgaagttatcgcagttgctgatatcgaacgtgtcagactcgttatcaaacacccagccgaactcaccgccctgcgcccactgtgacaaccgaatgctaaggccgttttcctgggcttctttcgtagccggctcaggcaaattctccagcattcgggtaatgccgtagacgcgatattgtggctcgtcattcatcacagcattaaccgcatcactcagacggcgttcatcgcgtgggaagatcgtcgagccgttgcgggtacaaaggattttcatcagttgcttgatgaaattgatattgcgtttggttgctggcaacgagaacgggttccaccctgtagactcaccactgataacccgatagtaacggccacccagcgcccggatgttcatctctgcgccccggtctttatcgaggtaaacggttgtcagccgtttggttttggcatccggggagaagctatcctcacgcccgtatttctgctgcatgatctcaaagaacgtcatcaacatggttttacccgaaccgttcgtaccgaggatgcaggtactggccgggttcttttcgttgaattcgtccttatctgccagtgtgttatgcaggttgatatagtagccatctcctgacggggtgcgcagtaaagccatagcatccccccagggggctttatcgcgcttgcccggatagaaattatggagtgcggccagctccacaaagttttggctacttagctcccctttacgtggccgcaggttgtagttgcctggcagttgcgccatatacgccgctgaaagcgatatttctgccggaacaggcgttatcccgatgttgttcagcgcattactgatttcgttagtatcagccactaggttttccagcgacggggaatacaccatgatggaaaaatggtgctttccgtaagcgattttccccgatgtcagcaggtcaagcgccacatccagatccagccgctgggaaacagcatcgtcatcggcactcatcaaaaggcgacgggtacgcttaatggctttcttcgcttcctcgcgtgacatgcaggtataggactgcgtgatcacgtaatcgcagggggcataaagaagggagtccatcatccccgtggcggtttcttcggagaactctttaacctccagcccccggaaatattgcgtaccgttggcgtggtttatctgcccggattcagccgaaaagaacaacgccgccgctcccatcacgtcataggccggggtgcgggtgacgcgcacctttcgccactggtgcgttaacagatattcatagaaagccagttgcgacgaaaacaccgcgcttccttcggtaaacgtaccgagaggccgcgcaccatagcgcgacagcgcggtatcgagcgtgctttttatttccagcatttccagcaaagcaccgtccagttcctttagtttctggctgtctttcatccgtttgcgttctgctttttcaaggctgacaaacgggcgatagcagactgtcaggaacaggcggttacgccggaacaccccgacagaagcgtagtaaagacggctaacttcatcggcatacgggttgccggaatctttatgaagattgtcggtaaacgtattgcggtcgttatggatatagaaagtgacgggcataccttcgaatgagtggattagcccgtgtaactggttcgtcccgaactggagtgattcgtcagactcgcagtcgaacggcgttcccatcaattcccaggtgcagtacagatcgcttttaggtgagcgaaccacatgctgatgaatgtgcgatgagtacggaatatacttcttgatggtggcacactgatttagtttcatggcgtcgagaaactccttgatatcaacagcctcatgctcaacgggcataagtgttgttgcgccaaataaacggtttgctaccggttttcccttcactctcagccaaacggcaatcagattgaaccgcattggttcatttctggtgagggatttcatcaccagaaattcgacgggaagtaagaacaggagtgcgacggaagtccagacagcaacgatgatggttacacccgtgacagccagcaggggcaccataggcaccccccacagcgccgccgggcgtttcattgccttgagcagctttgccatatgttcagcctcttagctcatcagcagagcgccgatttcactgcctccgccaattaaaatgccgccaatgatgatgtagccgcactgcgacaggctctcgcctttccacagggtcttatagccaatccagatcacggccacggtgatcgtgattgccgccagaccatgcagcccggttgacactttttgcatgacagtatttgcccgctgaaatccgtcggccagtgccggggttgcagaaaaagtcgtcagcgtacaggccgaaacgggggggaccacagcttttagcttgcggaaaagtatcattattcctcctcctcacggggtgacagggagaaactccggcgcactgacggcgcggagaacggtgcgatgaagattttttcttggcggagtttcgcagggacgccacggacgacgactccgggccagatctcgtggtgacgggatgagtcactggcaggggcggttttcaggggaacggcaactgatgatttgtcctcacgggttccggggaccgcatagcgggatgatcccggcggataaccgattcgctggatatagctcgttccggaaaacgccgtttcaggttgttgcccggtactgaaattgccggaataataacaactcagcgcccttttcagcgtgccgccgcgccggtagcagtctctgagaatgtgttcgaagacggacagattggtacagggatcaagtagctctgtggcggacacaccataatggcggaaattggtgctggtgatttgcatcagcccgacagagtaacggcgatcctgtgctgtcaggcggcggagaatatgctctgcatctccccggctggctggcaggtgagaaataatgtgttgatcgccgaaagaggggccggccttcgggacaatctcagcgatggcataagggttaaaaccggattccacccgtgccacgtcgaatgccgtggacggatgaatgctggcggcgcactgcatggctatcgccagaaaggctgtggtggaaagcatggtgacctcagtaaacaagtgacatgcagggtctgctgatactgcatgctgtgggaacagaattaagggtggttacgacacggtttcgatggggcccgtattctgtggtggattattttcctcccggggctcaagcaggaccagtttgccggaaacggcaataccgggcgtcaggacaatattcagaccggatttaccgtggtggggaaaggcgactccgacctttgtccaccaggtatttttctcaccctgagagtccggatgactttcctgggcaacatacgcgtaataaacaggctttctcatagtgtcctcgtttaattaaaattgttgaagatgatctcttcgatcacattccgatcctgcattccggttttaacgggtcagcgagaacattcagcggcaccctgaattatggttgtgtgacagcccgctccatattgttaaagagcatggtcaggatgcaggagggggaatgaaattttaacgggaaaataaataccggaaggaatgataaaaaagtatttgaaattaacgtattactggcacggtgtgtgtgtgcatgaatgatgacgggcgggctgataataatatttgttgattattatcaggttaaattaaacatccggaggaagactttctttatatgtcagatggggttgtatgctgtctctgtggctgaatttggtaacgacaataatgtgtaaggcgtgaaagacaggaatacagtagtcccttttgttgtaagggacggtctttaatctggttaaacgtttcccggccacttaggccgatacttaccgggccgggtggtgaaattcgttttcatgccgcagtggtatccgtctgtacctgttgcataaaaaacacagagttatctgacatatttccagacattaccgggaaccttatcaaagtactggtttattacaatctctgcgcggcgataatctgctgcggcataaagcatttcaagctcattccctgtgagcttttcttccatatgcccgacaaccttttccagcaggctgccgtcatttatttaccgcagttttctgacgaattccatcttgtttgccggtttgttcatgtctgacctctggtgtactgactgtaaaaaaggattgccacagcaggagatgtgagcaggttattcatccatgacatggaggcacgggaacctgaaaacaagccggctggtgcatattaaaatgtgcggagctattctcctccgcacatacagatttaacgtctgcgtttctccagtatcgactgacagtcagtacaggttgttacacccggcagcgtctgacggcgtttttccggaatagccttgccgcaaaatcgacagtgctgcagggaaggtgtcggtgtgggtcttaaccggctttgttcaatcagtgcttctaggcaccgttcattaaacgcctgatcgcgatcgatttcatctggcacgttgtattctccttaccgtgttctttctttcgcaatgcgtgatgcagttccagacaacggtcagcgagggggcagtacacgatgaaaggttttctgtaacctgcatcatggcgtccagcgcctccggggaatcaatgttttcgacccgatatttttgccactgatgccagattgcagcatcggtttcttcatccggaatgggtgttctcccgtttggaacggagacaccgagtaaccggcggcgtgcacaggtttctctggagccaaccccgaaataacggttcatcagtgcgattgagccccccagcctgacagctctgttcagttgttcctgacgcctgttttcctcgtgggatgatgccagtaatttttgcaggacatcatggcggatagtaatatcgacaagcggtaaaggtgcctgactgagggtgataagatcgtttattgataagcaaccgagcaaattcatttcatcgtaagtgaatcccatagtttcgcagtgatgaatatttccttcccgtagcgcctgaagagcaacggttaatataatatgattcagggatggaagcatgaaattgactccttaactgaataagtgctcagtaattcagctgaatattcagtgaatggtatagtttcatatagcacaataccgggcaggtctgaaatatacatgcaggtgcttttttttatacctgcaggatcgaagtttatgagtgcagggatattaatgttcatcatcttctcctcattgcgtctttatcggtcagataactttttgttgatccactcgtcaatctcagactcgagccaggcaacactagcagggcctatttttattgaacggggaaatgcaccctctttcatataaaggtatatctgtgaacgcttcagccctgttttttgctcaacctgtctgaggcgtagtaactgataagatgtcatatatcctcctgtgactgaaataaacggtggccggagaataaaaaaacacagtggaagcctgagagaaagctggtgagccctaaataagggatgcaaaacccttatttagggttgtcggccattacaaatggggatggtattagccggataaggatgtcgaagatggcgaaccacgcttcagcgcatttttcagtgtttcagcgtccagtttttccccgatgccatcgtctgatgcccattgttcaaaaatagaaaggagcttatagggatgattcagcagtgggctgatagtatcattgtgcttgcaggccagccaaaacaggcgtgataacggtgttgtcatacgggaaggtgaaatgggatgactctccctttttttgtataaattaattagtctttcgacttcggtgtggcgaataacaaaacaggcatcaggcggtaatgtataaagaggaaagcacccattgtgattatattttatggtcgtcacttctgttagtttttttatgacatctaatgctgtgtttttaggtagtctggaaatttgtttttctacgcgttctttccaactcatcgtttcgaaaatttgaaaaagctcctctgaaaatcttactataataccatggttagtttttcttgcccccacaattggggagggaaatttaagttcacgtgccagtatgcgctgaatcaaaacatattcatagcctatcaggggggtatctataatttgttgcacaggacaaacatatctggcttctgtacagagtcttaaattttgaccataaataaaaccgtccctgtcaagcatgcatagtttatcaagtaggtctccctcaaactgcctgaattttatttttccattaaaagtttgtatcttcttaagtatcacaggagactggaaatagaccgatagtaggatgttgccactcaaggcatgacgataaatatcgctaggagtaattttttgttttatggttttggtagtgatctcaactgcttccgttatagtgacccatgttgacatataatgagttataagcaatggctgatatttttttgacataatattatctccttctacacaacaattcgttccgttaaggaaaaagattggtgtcacaagtatttatttatgattaatcagagggtttatgacagagaaaaggatgtatatttctgagtgaacatgtacaggcctatggggtgactatttaatgagtaaatgccgaatgattttcggggtgatgattataacttgaggaaaaatcccagcgtggtttgagtagtgtacctgagtgatatttgtgttatgtatgcattgattgcagcagaataaatatagttcaggctagtatagtttgtggtagctatgagaatatataatctattttacctataaaataatttatatgtatggggtggtttttttgtggcgaattggttttactgaaccctaacttttgatttttaagtttgcacttattgatatgttaatatgataaatgctttatatcagttttactctacagaatttcaaaaaaatagatgtgttaatgactgtttttgccgatgaaatctttgagttttcgaaattgttttgagttgagggtgtgtaattgtaaaggtttattaattcgggttgttttttttaggttgtttgtctgtgcttttatattctggagatgtgccttgtatataggattgtttgttggttgtatttttaatgttgcactgttgtgaatttttattttgatatgattatttctttagtataaggagagaaaggaacgagaaagttaaatctatttgtcctaatcgcaatttcattgtttaaataatcactatggattaatattttttgcgactctgctgagttactggttttaactagtggtgtaaaagggataccttttcggtatcccttttacaataatcagaagaaatcaattcgcgtattgataccgacggtgcgacccatattgacctgcgcgacggcgctgctgccgttcatgtagccataggtacggtaacgacggtcgaacaggttatcgacatagacggaaatgttcatccgttcagtcgcctgccagcccaggctgctgtccagggtggcataggtgccttgccgcaactggttgtcgccatcgaaataatgcggcccgaccagattaaccgccagtcggggcatcagtgcgccatagcgcgtatcaatcacgccgttcacgctgcttcccgcgccataacgtggtacgaacggcacccggttaccgtgatacaactcactgtcattggtgaattcggaacggatcacgttgccattgatatcccatgaccagcctggcgcaaaccgccacttcgcttcaagctcaacgccggtggcgtcggctttacccgcattgcttaatgtctgcatcccgaccgggccagagtaaagctgcatgtctttggtgtgggtataaaacgtcgcggcttgcagcgtgacgtcagcggtttcgtagcgggtgccaagttcatagttgatggatttctcggcgacgaacggtttggcatcaagacccgcagtaggcacgatgttgtacccggaaggtttatatccctgggctacacgggtatacactctccagtcatcggtcagcatatagcctgcggatagctgcccgagcacctgatcgtcattgctcttaccctggtcgccaaacgggttgccgagcatgctgccgtgatattgtgtactggatttatcatgcgagaagcgcacgccgccgccgatatcaaaacgatcggttaaatgccaggtcaggtcactgtatgcggccagcgtttcagcggtggtatagccggtactgcttaaataaggcattgtcggcatgtcgtaggctgaatttaacttctcgcgggtgttctgccggtacagcccaaacaccatatcaacggtacgcgcatcgcccagggttgcggcgcgcagctcctgcacatcctgattccagcgctgaggcatattgacgattaacgaaccggaagggaaggtgcgcgaataatgctgctgctgccaggcgctgatcaggttgaaaacccagtcatcggtggtgtatttcccactcagggtctggctgtcagtgcagcgccgcatgtacgggtctggtgaaccatcgctgatcgacagcttacggcccttaatatcattccatcccacataggcgtcctgggtggcgcgggtacattcgcgtgaggcggcaaagcccatttcccagggctgatcgtccggcgccagacgcagtttcacattccctatgctggcgcgggtgccgcctaagtcatcgcttcccgtcgcggggttaatcatgtcgccgtcatcaacctggcgtaacagggtgacgctgccgtacagcaggccatcctgaatggggccgctcaggttgaacttacttcgataactgtcgcggctactgacgccgccttcaatatagccgcgcggcgtgctgtccggctgctgggtgacgatgttgatgatcccgccctgagcgcttttgccatataacgttccctgtgggcctcgcagcaactccacgctttgcacatcggtaagcgcctggatggtgttggtggaaagctgagggacgccatcgacatacagggtgacggcggggttatagaagtcctgcgctgaagagacgccgcgtagcgagatcgtcgaaaaaagcatgttgccgctattttcaatattgagcccgggcaagactctggggagtttgtcgctggcggtgacgccggcgtcgcttaattccggcgcgctgacaacagtagacgagacgttgttggctgatgccgagcgggaagattgtttactggcggtaaccaccagcgtgctttcgtcttgctgtgaagtttgggcattagcaatggcggggagcaataatccccccaaggccagaggataaagccgtgtcattttcattgttgtgagtccctgtaagacggcgaaacgccaaaaataccgacaatggtgaattgaaaatgataactatttctaatagtggtgctacccgaaacgggtttatttcaacctgtttcgggtcggtttgcgcttattgggcagaatggcgataacggtcgacggcgagagccgtcaggcgttttttgtctatcttgccgacggcggtgagcggccagtggtccagaaactcgatttggtcaggaattttccacgcgctgagccccatacgggtcagttgttgacgcaactgctgatagtcagttggcacctgctgcgcgatgataaacgcgcaaatccgctcgccaagcagcgtgtccggcgcggcgaccaccgcgcaatcttgcacttccgctaaacgcagcagtgccgattccacttcagccgcggctattttttctccggcgcggttgatctgctcttttatgcgtccctcaacgtgcaggttccccacctcatccagcctgacattgtcgcctgtgcggtaaaacccttgcgcggtaaaggcctgcgcgttgtgggcaggggcgcggtaatagcccgaaatggtataagggccgcgcgttaacaattgcccggtttcgcccggcgcgacgtcgttctcgtcttgatcaacgatgcggatttcatccagaggggacaacgggcgcccctggctgtggagaatggtggcatgcggatcgtccagccgggtaaaacagagcaggccttccgccataccgaaaacctgttgcagggtacagtcaaaggtggcgataacctgctcagcaagcgtcgggtcgagccgggcgccgcctgcctgaatgacgcgcagcgacgaaaggtcgctgtcttcccactccctggcctgcacccataattgcgccagcgccggaaccagggcgacgtgagtcactctttcctgcgcgattaaaggcatcacctcatcacagctggcgctgtcggtcagcaccacttttccgccgcaggcaagcgttcccagaataccggggcaggccagcggaaagttatgcgccaccgggaggacggcgagatacacgctctgttggctgatgccgcacagttcagcagaagcgctgaagttatagctatagtcggcatgtcggcgcgggatgagtttgggcgtgccggttgtgccgcctgagagcaacaacaacgcggtggcggaaacatcaggctgcggccatgcctgtcgctcaccgtgaagggagaagagcggcgtaaaatcgtcgctcacggtctctccagcgaccagaacatgacgcaagcaggcgtgtttgtgcgccatctgtcgggccagctctgcgtggttttccccgtgaataacgtaagcgacgggttgcgccagctcaatcagcgcgtcgatatccagcgcccgttgcgagggcatcgccagcacggggataacgcccagtcttaacaaggcgaacagcagggtaacaaacgcgttgtcgttgggaagctgcacaattacatgctcccccgaacgcaaacccagtgatgacagacctgcggcaagttcgtcaacttgtgcatcaagcgcgctgtaggttaacgacccctttgcatcaacgacggcaattcgcgaggcataacgggccgcccagtggcgcaactgttcggcaatgggtaagggatactgttcaatcagagattcaaaggaagaattcatgcgtcacctttctgaagtactgggctgtttttgcaacgcggtcattgcagaaaatgcgtggggaaaatggcggacaatctgcgtaaaaaaggaccgggcttgttgaatgggatagaaatgatcgccgtcaatcaccaccgggcctgtaacggggctcagccactgacgccaggcatcgacctgctgccaggaggcttcgcgatcgtggctgccgcacaataacagcgcaggcgtgcgcagcggcggacagacgtcgggcgagtcgtagtgatagctctcggtggcgtaaaaatcagcgcgcagaagaggaagaaacagcgacattaattcctggttttcccgcagttcaggagaacatccgccaatgtctatcagctcagcgataaagtcggcatcatcgcgatggctgagctggcgttcagaatgcagatgcggggcatggcacccggaaataatcagtccttgtggcgcaagcccccgttgctccagaagtcggcaggtttcaaacgccacctgtgcccccatgctgtgcccggcgagtaaaagcggcgtgtcaggcgatacggatgcttccagctcgttcgccagcagtgccgccagttgtgtaatgcttctgagcggttccagatggcgaaggcgatcgcgccccggccaggtcaccagagaaagcgcgcaatcagccagttgctcagcttgccagtggcgaaacgcgctactgctgccgccagcgaaagggcacatgactagatgcgcagtattaccgtttcgggcgggccacagcgggatgcacattgcagattgcgtcacagcgcctccttatcatcatcgttgtagaaaccggctaaccggtcgtggtgcggcggcgtcaggcgtctgatctccgcattgccggtcttacgtaaaatctgctgccataaacgtgataacgcgatctgatgtacgctttggcaggccgctggtggatgttcgcccgccagatggctgcgcaactggtgtagcaaccagctgacgccctccggcccgacggtttcgcagcagtcgcgccagctcaggggcgccgcgctgcgcgtcagacccggcagatcgcgcaggatctccggtctgcggtagaggctgtgggcgttctcctgatggtctgcgacaaacaggctggatgaccagatgacggggccgtagctcgcctccagcgaaagatgaccttccggccagcccagcagcaggcggtgcatgataaggctatgcatatctggatcgtcaggatcgagatagcgctgaagcagcaggcaggcttctccctccggccagaagagtctcagacagtgaaaatcgctaaagctgccaaccacgtcgcactccacggcggcggcatcaacgcccagagccagcaacaacaaatccagagtggagtagagcaactgtcggctggtggtggcgtggactaccggcggcgtcttagccaggcagcgacgcagctgctgcgcatcgcgaagccatgtgcgtcccgcgcgcgtatgcggataaaacgtgtttacccaatagcagcagccctgttcctgcgccagcgtttgtaaggaactgatgtcatccgggtggaggggatgctcctgaatgacgtgtacgccgcgcgtcagaaagtgtctggcaagctgcgtaccggttcctccggcgacggtcgaacgcacgacaatacaggcgatatccggcatcctggttatctgttccggcgaggtatacagcggaatgccaaacgcatgagccagctctcttgaacgggcgcttccctgcgccagcaggccgaccagttccagcccctccgggggctgcataaaggcattcaggtacatttcgccaaatttggcgcccacaatcagtacgcgttgttttggggaggcggacggcatcataacgtgttctccggttgcgttgaggttgcgcaaagccagcgcgtaatgtgttgcgcacaagcctgaacgtggggggcttccatcatgatttgccagtggctggcttcaatcacagcgtcgtcggcgttgtttatccagccctgccactcggtttctgctggcgtccagcgcgcgggtctcccggcggcatacaccatgagacaggggaccggaacgctttcgcccggcgtatgctcagtcagtaaacgcagcagatgcgcgatgttgtcgagccacgtttctgccgcttgcagcgtcaggttttgcggcaccataccggccgttttagcgaggctgataaagtcggcaagctggctgtcgggcgtctgctggtcgaaatgttcgggcagtgccagaggcgtttgtccttcggctaacaggcgcagcagggccgcccggttttcgcaacagaaatcctgtcggcacacgggatcgattaacaccatccgaacctgctcgcctttggcgtacaggcgctgtgcggcgcccgccgcaagaaacgcgccatacgaccaacccgccagcacataagggccgtgaggctgctgacgacggatgcacccgacatactcatcgatcatctggtcgagcgtggcaaagcgctgcggcgattttgcttgcaggccgaaaacgcgcctgttcaacgcgctagcgagcggcagccaggcgctgatatcgccgtctgaagcgtggaagacaaacagggtttcctcaccgtcgccctggcaaaggggtatcgggttgtcctctcctgacttagccgcctgtagatgggcgcagaagtcgctcagcgtcgaatggctgaacagatcctgaaggttagccctggcaatccctctccggtttagctgcgcgaccatccttgtcgccatcaggctgtcgccgcccagttcgaaaaagtcgtgatgccttgccacggggcgagacagcagcgattgccagagttcagccacctgtttttccagcgccggattccccccggcaactggcgtgggtttggctggctcagtcggcgcatcagacggggcatgcagcggcgtaaataacgcttctctttgccggatctgtaaaatgggcagaccggtgccaaagcgctgctgtaaatagcggctcacggcttttttatccgggcgatttacgccaggcgaacgcgccaccagcagatgctggcgcagcggcgacgattcctgcgcgggccacgccagctcgtttgcaaacccggcctgaacgagaacctcctgccatgcggagcgggtgagcatcggtttctcatcccggcggcggaaatcgcggtatccgcttaatccctcaataaagcccacgctcgccagctggaatacgctgtttcgctccgtcgcttcaacgatcatcaaacgtccgccggctttcagcaacagttttaatctgcgcaacgtctggacgacatggctggcgtcgtggagcacattgacggcaacgatcaggtcgtaacccgcctccgggtgggcggtgaaatccagcggctggttgatgtcgaacaaggcataagacacctgcgattcatcatggaaacgggctctggcgtcattgaggaactgcgcggagacgtccgtgaagtggtacgactgccgcgtgttccgcgtggccttcagcaccggcgcggtagtggctgcggttccggcgccaacctccagaatccgttctgcgctgcacaaggcggcaatctgcgcggtatagcgattcagacaggcgctggcggggttgtcgcgatacagcgcgtcggtaacgcgatgctgctcgttgaacagcaattccagcggagaacactgcccggagaagagggcgtcgtgccgggcgatgcaggtttccagatactgcgccagcgcctggctccattggctttgcgggcacgcttcctgaggctcaggaatctcgctgagcggaatgcggcagcgccagctttcaccttcgcggattaaccactctctttccgtcagacactgtagccactggcgcagcagacgctggtgagacgcttgcgcggacagcgcctgtactattgcgctaaagcgatgggcgatctccggcgtggtaaacaggccgtgacgatttagcgtagccgcgatcccctgtagcgcacgcgcctccagccagcgccaggtcgcctccagctcatcaagctgcgcctgctcaggcaacggcagcgccagttgggtaagttcgtgctcatcaggcatcgccgctgatggcgacggatcgtcggccatcacgatatccagcgtcaacgcgccctgttcggttatttccgctctggcctgccggatgccggggtattcgagcgtcgcctgctcaatatcccgcaggtcgtagtccgcctgcgcgttcagcggccagcgtcggcggggaatgtgcccggcgatgccgctggcgagagtcttcaggctttcaggggcggcgatgacggcttgcaggatggcgcaatagtcattaaacatcgcctcggcagcgccgggttccagcacgttgtccatgcagtaccagctaaacatcaactcgccgtcgctctccatgacctgatgatccagccagacctgcggcgtttgcgtgaatacatagcagggttcgccgaacagatggctcatcgcctgatcgatagtcatgccttccagcgtcatccccagcatactggtaaacactaccggcatcagcggttgacgttgtgatccgcgcaggcggcccagctcacggatcacctcaacaccgttcatttcactgtgcgccatgttttgccagaggcgctgttgggtctgttgcatctgctcttgcaacgtcaccggcgctgagaagttaaaatcaaccagcgtgacggaggtaaaatcaccaatcaactggttgatttgcggatggatcggctggcgattgaagaacgtcaggttcagcgtaaatgttgtggtacggctccagcgctcaagggtggcggcaaacagcgtgagcagcgcggcagacggtgtgacgccttgctgctgccagctctgtttcacggcctgccattctgtcttgccgatcgtcgatttgaaggtggtgaagtgtggcgtttccgggggcgtctcaaccaccggcagctctggcgctaagggcagttgcggcagtttttcctgccagtaatcccaggcatcgtgccatgccgatgtctgtcggcgcgcctgttcagccatcacataatcacggaaggtaatagcgagcggcgccagcgtttcaccgcgccagacctgcgccaggtcgtccatcatgactttaaaactctgcacatcaaactgcaaaaggtcgaggttcatatgcagacggtaatggcaatcgtcgatttcgctgaccaccagctcaaaaagaggccactggtcggcaggcaaaacgcgatagctcagttcatgccgccgtttttccagcgcgatgcgctgttcttccggggaaagcgcgcgcagatcgtcacgcgggatgtgatactccggcgttgtcgccaggattcgctgctgcccgtcggcatcaaccaccatacgcaacatatcgtggcgtgcgatgagctggttccatgctttctccagtatggcgagattgaactcatcgtggcatttatcccactcaaacaggacgtgacaggcgacgccgccatagccaatgaggtgggttcgccccagccagtaggcgtgctgaatgggcgtcaaagggaagggcgcataacgctcgtcggcgtcgtgccgcaacacttccggctgcgaagcggcaggcgtcgcctctggcttagaacagataagctgcgtgagtccatgaggagacagatcctgccacgcccgttccgcattgatgcgtacgcccaggtagtgctgaatatcgctactgagttcaaggaagagcagcgagtccatgccgagttgcaacagatcctggtttggatgcagtgacgccggatcgctcagccttagctgaaccgcaatccgctttttcagccatgccatcaccgctgtttcatcgctcaggctgccgttaaaggcgttgtcatcagcaggaggaatgaccggcgttgcggctttttctgtggcgctgatgttaaacagagcctgttgtaacgggggcattttgtcggtaaaaacgcgcatcgccagtcgccacggggcgccgcgcatcaccgcctgttccaggtgccagcagccttcggcatcgcttaacgcgcccatacctcggctggcgagcgtcgccagcatttccggcgtggccgcccgaccgctttctccccatgcgccccaggcgacagagagcgttttcggcgcatcaagggtggaaaactgctgggccagcccgtccaggtagccgcaggccagcgcatgggcgctctgacccggcgcgccgagggtggcggcagcggaagagtagagaataagatagcgtccgtcgtggttgcgcagggtttgcaacagctggcttgccgcctgcgcttttaccgcgaaaacggcagccaactggtggtcatcaagctcctgcaagggcgcgtcagccaatacgccagcggcatgaatcgctccggcaatgccgccgttggccgccagatcgtcaagaaccgtggccagttgcccggcatcgcccacatcacaacggcagacgcgcgtctgcccgccctccacgtcgcgtagccatgactcatccacgcgcggcgccagcagggcgatgcgtcgcgcccctttttctctgagccagttcacggcaaggcggcctaatccgccaaacgctccggtcaccagatgccagcggctatcgccggtaaacacgtttgccggtaattcagcggcgcatcccgtattgggcgccagtgaagggagccaaagggtgtcaccccgtgcggcgagccagcgctgtgatagtgagactgcgctcaacccttgatgcagcgtttcccacggggtgttttcggcgagatcgatggcggcaagcaaccgttccggctgttcgttggccgcgacgcgaagcaaggcccatagcgcgtgatgggatgcagagagtgcttcattttcctcgactcgccacgcgcggcgagtaaccacaatcaatccggctgcgctggcggtgagcgctgctatcactttctccgctaaggccagcgtatcctcgctctcctcaacaatcatcagtcgtgaagaggcgtgcggatcgtgaatgatgccgtattgcgccagctcgtcgctgcgcgcaagcgtaccggcgctgaagctaaaggtaagcggatggtcaatgctggcgacgttgaggggcgtccagcgccattgataatgcgtctgcggcgcaggaagaggcgcggcgggcgatagcggcagccactcgccagcaggatgacgggcttcaacgcgcatctgaccgcgggaaaaggcttcgttttgccagcttaagcgaaccttccccagccactccggggcggcgacggggggcggttccacaggtagagcgtcgccatgacgctgtgaaagcagacgccaggcctcctgccagcgggcgttaaaccgttcgggctgacctgcgcaatcagaccagtcggcgagataatcaccgttatccgtcagcgcctgccccaacacgggttctgatggcgcggtgaatgttacggcgctaaccgcctgaccgggcagcgtggcgagaatgatatgttcgctcatcccggcggtcgggctgccatcctgcggtagccacgccactttgctgaatccggcgtggcggcactgttgttgccactgagcggtggtgaggaataactcaccttcgcgggcgtcgagatcctgtagcggaagaaccagcgggccgaaaacgaagtcaaacagacgcattggctgggtgatttcgcgcatcagcaggcgcccgcccggcttgagcagggggcgcagattatcgagcgtgcggccaatatggcgggtggcgtgaatcacgttcgctgccacgataagatcgtaagactgtgcctggaaaccctgagactgcgcctctttttcgagatccagctcgctatacttcacaaaatcatagtcggcgaatttctgctgggcgcgacgggtgaacagcgccgagatatcggtgaaatggtactccagtgccggaacgccgttgagttccggcagcagccacgcggtggtgccgccggttccgccgccaacttcaagaatacgcaacggctggcggggctgacgcgtctggacaatgccgcgtaataccccggcggcgatttggttgaaatagcggccaaagctgaattcctgatacagcacttccacgccgtcggaggcgctttgcgggaagataatcgccaccggttcttccgcgccgctcatcatttcatataaccgatcgccggcacgggcgatggtgtcgggaatagcctgaaaaccttcacaataaccggcaagttccgtcagcagtgattcccgctgttgatgttcaatggggcgggcgcggacgtatcgcccgtcggtgcagcggtaatcgccgtcgaccacgcagttattcagcaggcgctggagtagctgctggtagcggggcagcagacgtccacggcgcatgatggtcatggcgtccacgccgttctcaatggcatcgccggtacagcgttgtaccagttgatcgacgtagatggcgtgcagtcgcgtggcgcactgtttaagcgcttccaggcgagggagatcgagcgctgtcgcggcgcgactcgccacctccagcccggcagacagcgctgcgtcggcaggctcgcaggccggggagacgcgctctttccagtaacgctcagtatcaaacggataacatggcgcagcgatacgttgtccatcgcccgccagcaggtcggcccacggtagggcgacgccggcagcgtaaagctggagcagggcctgattgaggacatcgctcgcctctttgttacgccgggcgctggctatccagtatgcgttatcgcggtattcgcgctgcccgcaagcaaccaactgggcatcgggccccatctccagaaaaacgcgggcgccgagctgatgcgccacctgaatactctggataaaacgcaccggctggcgcatgtgtcggcgccagtaatccgcctggttgagcgttgactcatcaatgacgtcggcggtgagcgtggaaataatcggtatttgccccggctccgcgtgcagtcccgcgcaggcgtcctggaaccgatcgagtatcggctccagtaaagcggagtgcgccgcaccggttacgctcaggcgacgatagttaatgtcatgctgcgagagcgtggcgcaaaataccgcgagacgggcttccggcccggaaaataccgtatgttgcgtaccgttgttggcggcgagatccagctcaaactggcgagccagcggcatcagcgtgtcttcgtctgcaaataccgccaccatcgcgccgcttgcgcactgctgcattagcgcgccgcgccgacaaaccagtggcatgacctgttctatcgtatagtgtccgcagacaacggcagcggcaaattcaccgacggaatgcccaatggcgaagtctggcttcagtccttcagcacgccagtgcgccgccatcgcgatttcaaacgcgacaatcgccggctgcgcccaggccatattgtccagctgcgccgaatcggggttaaacatcgcttcgcgcagtgacggcgtgagcatttcgctacaggcggaaaaacagcgatccagcgtgtcggcaaacgccgttgagtgctggtacatcgtttgacccatagtgcgccagtgcgagccctggccggtaaacagccacacctgcttgccgctggcgccgtggccgctgtaaaccagcgcccccgatttctcaccggcccaggcgctgagcgcctcggcggtttcacggtttaatggcgccgccaggcggaaggggagatcgagacggcgcgcgtgcagggctgtgaaggccagagagctggcatccgcatcctctctcagcgccccggcataatccgtcgccagccgccgcaacgcgctgtcgctggcggcgctgagcagcagcgcggtactttttctgccgctatccgtatcggggaggcgcgcgttgagcgcgtcgggcagcgaggcgacgatcatatggcagttggtgccgccaataccaaaggaggagacgcccgcatagcgcatttcgtcctgccatgcctgtgccgacaccggtatggtaaaggggctctcttcaagtttcagcgccgggttgggggtgtgaaaattcagtaagggaggaatttgcccgcgactgactgccagaacggttttcagcagtccggcaatgcccgccgcggtatccagatggcccatgttacttttcacggaaccgagcgcacagcgctgatcctgcgggcgaggcgcatagacgttgcgtaacgcttcaatttcaatcgcgtcgcccagcggtgtgccggtgccgtgggtttcaatgtaacctacctgcctgtcgtcgatggccgccagcattaacgcctcttcgatgactgcctgttgccctgcgacggaaggggcggtatagccgacctttctgttgccgtcgttgttgaccgcgctggagaggatcaccgagataatcggatcgcctgacagcagcgcgtctctcaggcgacgcagcaccacgcagccgagaccgttaccggcccaggtgccctcagccgaggcgtcaaagggacgacagtgaccatcaggagagaaaatcattccgggctggtagcggtagcctgcctgctgggggaaagagagcgccacgccgccggcaaccgccatatcggattcgcctgcgcgcaggctttcacaggccagatgcactgcaaccagcgagctggagcaggcggtctgtaccgataacgccgggccgtgcaggttgagtttgtacgcggcgcgggtggcaatatagtctttatcattgcccatcagagattgcagaccttttacctgcgcgacttctgtcacgttcaatgcttcgcgaccggggtaggtactcatccgggaagaggcgaaaacgccggtcttatgggggacggcgccgggggcataaccggcatgttccagcgcatgccagaccgcctgcaaaaataggcgctgctgcgggtccatcgactccgcttcctgtcgcgaatagccaaacagggtggcgtcgaagcagtcggcgttgtctaacaccgtaccgatattgacataatgaggatcgtcaatgatggcggcatccagaccgacggccagaagctcttcgcgcgtaaagcgtcggctgcattcacgaccttccagcagattttgccagaacgtttcgccatccggcgattcaggaaaatggcaggcgtagccgataaccgcgacaggttcgcagtccgggtagtgttgagcgatcgatgcatcaatggaatctgctgtcggcgcagaagagaagcgcaagttatccataatcggtcccgtttcctaagattcacaaagtcaatggaacgccatgcgttcgcgatggcgttccggggaaaatcagtttgcttcgcgctatatccgccgctgacgacggcgaacagggcgaggtcgttttgttttctccaccgtggcgacgccggccagataatcggccagggcagcaggagaagggtgggtgaagaggtcaagcaacgtcagggtggaaaattcgtgacgttgtaacaaaacgtgcagttgcaccagattcagcgacgttgcgcccgcctcaaagaagttttctgcgggcgtgacagactcgccaaccacctcgcggaaggcgtcgcaaatcaggctgacggtgctctcgtccgccgcaatgtgtggctgagagtgctcagggcatacgcgcggtgagcgctctgcgcattgccctgcgtgtttaacgggaggcaccagcgcggcgagcggcagttgccagccgctttcatcctcggccattcggtttagcaatgcgcaatgctgttcaaactggcgctccacctgcccggcaggaaacagcgcggcgacaaaatcccagttaaagcgcagttcgccttcggattcataaatctggtgatcgagccagacctgcggcgtctgggagatgccccagaccggtttgagcagattacgccgggcgaggaagttatcctgctcaaagcccagcgcgctggtaaagacgacgggcatcggaacggcaggcacgttttgccgttgcgccagttgacgcatcacgcggatggctgacacatcgcggtggttgaggttctggctcagccgctgctgtagtgactgcgcgctgtgcagccagctttcgccgggatgccagctcagcagcatcagcgaggtgaaatcgcccagaatctggttgatttgcgggtgcagcggtcgcctgtcgaaaagcgtaaggttaagcgtgaactcaggttgtgcactccatgcagagagaaccgttgaccacaccgacaacagtacggccgacggggtgagatgggcgtcagccgcccgttttttcagccgatgccagcgcgtgctgtccagcgcgccgttcaggcgggcgaagcgcggtgtttcaacctcctgaggcaagcagcgcagcggcaacgcaggcgccggaggaatatcatcaagctgcgcctgccaccatgccagagaatctggattgggcgactgtagcgagggttgttgcagataatccctgaaggtgacgggcagcggcggaagcagctgttgcgggtagcggtagccgtgctccagctccgccagcaggatctgcatgctcagaccgtcaagcaacaggttatccagacacagccacaggcgggcaggcatcccgtccacgtatccgacctggagatcgaataccggccacacttcggggttgagtacctgatgcgccagtttttcgcgcacccgcaacgcctcttcaggcgtatggagggtgtgtgtgggtatcacccaggggggcgtctgttcgagcacctgttgctgtccatcacgcacgatggcgcgcagcatatcgtggcgggcgattaatcggttccagaccgtctccagccgggtgaggtccagatcggcaatttcaaattcaacaaagaaatgtgagccgacgccgcccagggcaaagcccggctgacgccccaccaggtaagcctgctgcacgtcggtaagcgcaaagggctggtagcgttcttcaggggagtggacgaatggttgttcgaccgggacgtcggttttccgcagcgtggcggcaaaatccgccagccggggatgattaaacaggtcgcttaattgcgcttcataacctgcctgatgaagttgcccggtcagacgggtcgccagcaggctatcgccgccttgctggaagaagtcggtttctctggtgacattgccagttgataagagttgctgccagagggcggcaacctgtttttcaatgtcgccctggggtaaatccgcttcggccgggttttccgcttcaggggtatgacgacgcttcagcgcctggtagtcaattttcccgttagccgtcagcggtaaggcgtcgaggaagacgatccgttgcggcaccatccaccccggcagacgtccggcgagggcggcctgaagttgacggggatcgcggcgcacctgcctgtcaggacattgtacgaggaagcgttgtaaccccgcgacctcatcgccatgctgacagttgaaggcggccgcgctaaataatgccgcccagtcggcgctgttatgcagcaaggcctccggctgcccattggttaacaggagcgtgctgagcagggcggacggcgttaactggcgaaactccatcacgtagagcagcgcgccgggaacggcaagctgttgtaatgtcgcaaggagcccgggatcttccggcagcagacgatgcagggcgttattaagccagataatgtccgccgagtgagcgtgcgccgccagcgtgtctgcattccagagggacagacgggcgccaggccagggggcgagcctctgccgggcgctcagcagcatctcctggctctgctcaagcccgacatactcaatctgtccggcgttgagctgtgctaacagcgattctgcggcgcggccagtgcgggttcccacatcaagcaggcgtaccgggcgctgtaagcgctgtgcaagctgttggcaaattgtcgccagttcctgaatatacggggcgctggccggatggttaaaggccaggctttccggcgaccactgcgcgtcgttcagtaacgacagttcgttacgggcaccgcgaagaatttgtgataacgttaaatcatgtccgctgaagtgcgggtgctcatcctcgtgttcttcaccagcgcagacctgataaccttcagcagcgggcttcagtcgccgttgtgtcaccagaaatgctaaccagagttccaccacggcctgccagcgcggctggatagcgagtgagttcatcagggggagaggatcggcgccagcggtgtgacccggcttcagttttagcaggcgatgctgaaggaaatcggctacctgttctgcggagatctctggcgagatggcgcaacagggcaacgttcccgcaagcgtgtgccacgcctgcggcagtgccgggttccgatgatcggtaacgcaaaaagcctcgccctgaggaacaacgtatgccgccagcgttttttctttttcgccgatcgccagaacggttgcttgtttcacccccgccagctggctgagcgcgctttcgatttcgcccagctcgatgcgatatcctccgactttgacctgcttgtcgcgacgaccgaggaactcgattgtgccatctggccagtagcagccgagatcgccggtgcgataccagcgctcgtccgggagcgtcaaaaattgctgctcgctacgcaggggatcgttgaaatagccttccgcgaccccaatgccgccaatccataattcacccggcacccagtcagggcagtcccggccctgttcatccaccacccggtagcgttggttggttagcggaaaaccgtaagggatggagcgccagtgggcggggacgtcgtgaatttcgcaggcgttagaccagatagacgcctcggtggcgccgcccatcgcgataaattgtccttgtggccggaaggcccgataacgggcggggaggtcaagcccgatccagtcgccggaaagcatcactgcgcgcaggttttccggcgtggcgtcggcgaaaccttcacaccaggtcagcagcatatcgaacagcgccgggacgctgttccagagcgtgacctgatggcgctggatcagctcacaccatgcgtgaggatcgcgccgttgattttccatcaccatcaccagcgcgccgcccgcgcgcagtacgccaaaaatgtcgtaaaccgataaatcaaaatgtagggcggagagggccagcaccctgtcatgcgggccaacctgatagcgggtattgatatcgcaacaggtgttaagcgctccccggtgagaaatgactacccctttcggcgtaccggtagagccggaggtgtagataatgtaggccggttgcgtgggggcgcgtactaccgggttggcgatcggctccgcctcaatggcctgctgccaggcaaggacgggaatatcgtctgacccggcgctggtgtcgtgctgacaaatgagcaccagccggacgctggcgtcagcgtagattttctcgcgccgtgcggcaggctgatccagcgaaaccggaacgtaaaccgccccggccagcaggacggccagaaccgcaacaagttgtcctgcgcctttcgacatcgtgatagccacattatcgccgggctgaaccccgcactcgattaacctgcccgcgcaacggcgggcatagtctgtcagctcatgataattccactgataacgcatgtccgttaccgccagcgcctgcggctgttgcagagcgatacggaaaatgccttcatgcagcaagccttcgggaatgggggcgccggtggcgttgacccgttcgcgtatcgcgcgctggctggcgggcatcatatctgcgaacggcttttgccaggcgctttcgtcatcgcagagttggttaatcaactggcagtaggcgtcgaacaatgtttcgactaacgccggagggaacagcgcgtcgttgctgtcccattgtagccagacctcgccgtgatgctcgaacgccagatgatctatccagacctgcggcgtttgcgagatgccccattccggctcgcccaacggcgattctgcgcggctgctgtagagggaacgccccagattgctggtaaataccaccggggcgccgtgggggtagcgctgctggcgtttgagttcacggagtaattcgacgccggaccagtggcgatgctcccagtcctccgtaaacgtgagctggtttttacgcgccaggttgctgacggtatcgccatcgcaggcggtatccagcagaagaatattggtgaagtcggcaagcatcgcgccaaccgccgggtgcagcggctggcggtcgaataaggtgatgttaagcagcagacgcgtcaggccgccccagcgagccagcacggcagaaaaacaggtcgccagcgccattgtcggcgtcacgccatactcgccggcccggttgctaaaggcgtgccagcgtgttgccgggacaatcatgcggcgtcgggtattacggacttcacgtagcgtggcgggttcgcaggccagcggcaagacgggcgcggggggaagcgtcgatgctttcgccagccagtaagcgcgcgcgtcgtctctcagtgtttgattgatcttctgctggtgcagcaaatacgagcggaaatcatagcgggtgtcgatagccggcagcgattctccggccagcagggcgttaagctcatcgaagaaaagcgtaaagctggaggcatccataatcagcaggtcaatattgacatggaggcggtggcgattgtccggcaagagcgtcagctgaaaatcaaacgtttcgccgatttccacgcgtaaaagacggtggctcaggcgctggcgcagtgcgtccagataggcctggcggctttcagcgtcgttatggcgtaaatcatgaacggtgacgccgttccagtaaggttgcggtagccagacctgctgcccgtcggggcgaaaggcgatatgcagcattgggtggcgttgcagcaaggtcgtgatggcctgctccaactgcgacgccgtcagacaatggccttcaaactcctgatacaggtggcaacccacgccgccaagcgtctgccccggcatgcggcccgtcaggtaggcgtgctgtactggcgtcaatgggaagggggtactttcggtcatgttcggccaggatgattcgtcgggcggcgtttcttcttccgcgttctcaggcgaccggctgagcattaactggttccatgccgccagcgtgggggcggcatacagctcgcgaagggtaaggcggtagccatttttacgaaaccagtgtaaccatctcatcaatcttatggaatccaggccggcctggatcaggttgctctcttcatgtaactgctgcggcgttaaattcagttcctgtatgagccgctcgcgtaattgttggtaatcagccgcgtggcggttgtccggtaacagcgaatcctgagatggtgcgccagaaatcattcttcctcctgatggcacgtcttaccgaaaagcattgctcatatgagaataataattattaacaattggatgctacccgaaacgggtttatttatgcccgtttcgggttggtaacaggcggaaagaacagaggcccggatggggtatccgggcctctgtcagggaggagtttaggggggcgcgaccccggttacatcacgcgtttaaaggtcgaaggggttacgccaaactgtttctggaaggcggcagagaaatggctggcgttggcatagcccagatcggccgccaccgtcatgacggaggtattgccgttggccaggcgtcttctggcttcctgcattcgttcagcctgaaacaggccatagacgctgttgttgaacagaacgcggaagcctcgcttaattttgagaacgctcagaccggactctctggccagctccgcgacgcccggcgcttgcgtcagatcagccagcagcagatccttcgcccgcagcagtttctggcgttccatcgggttgaagtggcaggagaggcaactggcgtcttcgcgatgttcatccagcaccagactgagcatgaccagactttgcccctgcaaccatagcgtcgacggcttttgttcatgactgaagccgccgtgcatgcgcatcagcgcgtgacgcaaggcctgagccgttaagtgggtttcagcattacaacgctgctgctggcaacagcagtgggagtcgatcttattcttaatgaccgcgctaatatccggcacccacagcgcgagggtttcagggctgaaggagagggtaatgctctcgaatcggccacaataggaggcgctgccgcgacagtctggcgtatgggtaatgtaatggcgattgcgcgcaagctcccagtcggtgtggcgccggagtccctgaatcgcaaagcgcgatgtgccttccaggatgcacgagaagttaatcctgcccagatcgtcgtgtagctgcaacgtctcaggccgcgcaaaatggcccctccagagcaaaatatccataccttcctgcaacgaacagcgcagcagttcacactgagcaggaatattgccatcgtttgcaggtttcccgaccaccaactggtgaatagagatttcagattgcgtttgcggtgactccgtcatgacctggttatctccctgtggcttagaccaatgcgggtataaatagaaccgaatggggtagatgagttattgataatggttattattcacattaattctcagaacgccaccctgaattgtcgtttttggcgtccgtaaaaattcatcaggaaattcagttgctcccatgtcatctcaatcatccaatactgaatcgctgtcccgatttcctctctggcaggtgattacaccggttcgcaggaaggttattttagctatggcgctggcggggctggcggcattaaccagcctgggggcgctcctttttctggcgtggagcctgcgtgacattcgcgcgacgcctgacgctattccggcctggccgctgggcggcgtgatcggctgcgtggtcttaacttttgttctgcgcttacaggcgttcaacacctctcattacgcggcttttcatctggagaacattctgcgcagcaggttagcccgtaaagcattgcagcttccgcctggcgtgttacagcaaatgggcagcgggtcagtggcgaaagtgatgctggatgacgtgaagtcgttacatatttttgtggccgacagcacgccgctctatgcccgcgcgatcatcatgccgctggcgacaatcgttatcttgttctggctggactggcggctggcaatcgcgacgctgggggtactggcgtttggatcggttgttctcgtgctcgcccgccagcgttcggaagatatggctcagcgttatcataaggcgcgcgagcaggttagcgcggcggttattgagttcgtgcaggccatgcccgtggtgagaacgtttgatagcggcagcaccagttttctgcgctatcaacgcgcccttgaagagtgggtcgatgtgctcaaaacctggtatcgcaaagccggtttttcagcgcgtttttccttctcgattctgaatcctctcccgaccctgtttgtcctgatctggtcgggatacggcctgttgcactatggcagtttcgattttatcgcgtgggtggccgttttactgctgggcagcggaatggccgaagccgtaatgccaatgatgatgctcaataacctggtcgcgcaaacgcgtttaagcattcagcgtatttatcaggttctcgcgatgccggagttatcgctgccgcagtctgaccagcagccgcaagaggcgagcattacctttgagcaggtgagctttcattatccgcaagcgcgtactggcgccgcgttgcaggaggtgagctttcatgtgcctgccgggcaaattgtggcgctggtcgggccaagcggcgccggaaaaagcaccgtggcgcgcttgctgctgcgttacgccgacccggacaaaggccatatccgtattggcggcgtggatctgcgtgatatgcagacggacaccctgatgaagcaactctcgtttgtgtttcaggacaacttcctttttgccgacacgatagccaataacattcgtctgggcgcgccggatacgccgctggaggcggtaatagcggcggccagagtggcgcaggcccatgattttattagcgctctgccagaaggttacaacacacgagtcggggaacgtggggtatttctctccggcggccagcggcagcgcattactatcgcccgggcgcttttgcaggatcgccccatcctggtgctcgatgaggcgacggcgtttgctgacccggaaaacgaagcggcgcttatcaaggcgctcgcggcggccatgcgtggccggacggtcatcatggtcgcgcatcgtctctcaatggtgactcaggccgatgtgatattgctgttttccgacggacagctcagggaaatggggaaccatacgcaactgttggcgcagggcggcctgtatcaacggctctggcaacactatcagcaggcgcagcattgggtgccgggtggaacacaggaagaggtggtggaaaatgaaagacaataatcctgcggataacctggcctggcgcgtcatctggcgccagcttatctccagcgttggcagtcaggccaggatgctgcgacgcagtatgctggcgctgttgctggcggcattcatgcaggggatcgcctttgcctgtctttatccgatcattgatgcgctgttacggggagacgcgccgcaacttcttaactgggctatggccttcagcgtcgccgcaattgtgacgctggtgctacgctggtatggcctgggctttgaataccgtggtcatctggcgcaggccacccatgagttgcgcctgcgacttggcgagcagttacgccgcgtgccgctggagaagctccagcgcggcagggcgggtgaaatgaacgccttgctgctgggcaacgtggatgaaaacctcaattatgttattgcgatagccaatattttgctgctcaccattgtcacgccgctgacggcgtcgctggcgacattgtggatagactggcggctggggctggtgatgttgctgatcttccctctgctggtgccgttttattactggcgccgcccggcgatgcggcgacaaatgcagacgctgggggaagcgcaccagcgtctgagcggcgatatcgttgaatttgctcaggggatgatggtattgcgcacctgcggcagcgatgccgataaaagccgggcgctgctggcgcatttcaatgcgctggaaaacttacagacccgcactcaccgtcagggcgctggcgcgacgatgctgatcgccagcgtcgtggagttgggcctacaggtggtggtgttatccgggatcgtctgggtagtgacgggcactctgaacctcgcctttttgattgccgccgtcgcgatgattatgcgcttcgcagaaccgatggcgatgtttatcagctacacctcggttgtggaactgatcgccagcgccctgcaacggattgagcggtttatggcgatagcaccgcttcccgtcgcagagcaaagcgagatgccggaacgttacgatatccgctttgacaacgtcagctatcgctacgaagaaggcgacggccacgcgcttaatcatgtttctttgacgttcccggcagccagtatgagcgcgctggtgggtgcctccggcgcaggcaaaactacggtcaccaaactgttaatgcgctatgccgatccgcagcaagggcagatttctattggcggcgtcgatattcgccgcctgacgccggaacagctcaatagcctgatttctgttgttttccaggatgtctggctgtttgatgacacgctgctggcgaatatccgtatcgcgcgcccacaggcgacgcggcaggaggtagaagaggccgcccgcgcggcgcagtgccttgagtttatttcccgtcttccgcaaggctggctgacgccaatgggagagatgggcggccagctatcgggcggcgagcgccagcggatttccattgccagagcgttattgaaaaacgcgccggtcgtcattctcgatgaaccgactgccgcgctggatattgaaagcgagctggcggtgcaaaaagcgatcgataacctggttcacaaccggacggtgattatcatcgctcaccgtttatccaccatcgccggggccggaaacattctggtgatggaagagggacaggtggttgagcagggtactcatgcgcaattgctctcacatcatggacgttatcaggcgctgtggcaggcgcaaatggccgcgcgcgtgtggcgcgacgacggggtttccgcgtctggagagtgggtgcatgagtgatgttcagtcgaatgtgaaaccgctgacgttgacgaccgggcgggtgatttttgctattgccggcgtctatgtgacgcagagtctggtatcggcgctgtctatgcagtccttacccgcgctggtgcgcgctgctggcggttcgctggcgcttgccggtgcgacaaccctgtttatgctgccctgggcgctgaagtttatttgggcgccatggatcgagcgctggcggcttccgcccggtagccaggaacgccgttcccgcatgttaatcctgcgtggtcaggtcgcgctagcggcgatcctgactattgccgcagcgattggctggtttgggcgagaagggggattccccgatacgcaaatcgtcgcgttatttgttctgtttatggtggcaggcacggtcgcctccaccattgatatcgccagcgacggcttttgcgtcgatcaactgacccgcacgggttacggctggggaaacagcgtgcaggtcggcggcagctatctgggaatgatgtgcggcggcggggtgttcctgatgctgtcggcggcatccggctggcctgtcgccatgctgatgatggcggtgctgattatggcgctgtcactcccgctgtggcgcattacggagccgacgcgaacagcgactatcccgcatgttccggcgttaggttatgcgctaaggaggaagcaggcgcgcctgggcttactgctggtattgatgctgaattcaggcatgcggtttgtgctgcctcttctggcaccgctgttgttggatcatgggttgagcatgtccgcattgggcgcgctgttcagcggcggcaatattgcagcgggcatagcaggaacgctggccggcggattgctgatgaaatacacctcacccggcagagcgctgttgacggcttatggcgtccaggggatcgcgctgctggcggtggtgatgacgctcatgatggcgccgggtcatctgctgctgccgattctccagtgtctggtcattgtccagtccatttcgctggcctgcgcgctggtctgtctttacgccacgctgatgtcgctttcatcgcctttgcaggccggtgtcgacttcaccctctttcaatgtactgacgcggcaatcgccattctggcaggcgttatcggtggcgttgttgctcaacattttggctatgcggcctgcttcctgtttgccggggcattcacgttgctggcggcgtgggttgcttatatccggctgcattcggcaagagaactgatgacaagcgcaattgattgatccgggaataacacagagaggtaagggatgaaaatcagtgaatttctacatctggcgttaccagaggaacaatggctaccgacgatttctggcgttttacgccagttcgcagaagaagagtgttatgtctatgagcgtcaaccctgttggtatttaggcaaagggtgccaggcacggctgcacattaatgccgacggaacgcaggcgacatttattgatgatgccggggagcaaaaatgggcggtggattccattgccgactgcgcgcgtcgttttatggcgcatcctcaggtgaaaggacgtcgggtatatggacaggttgggttcaactttgcggcgcatgcgcgggggattgcctttaacgccggggagtggccgctgctgacgttaaccgttccccgtgaagaacttatttttgaaaagggaaatgtcaccgtttatgcggactccgccgacgggtgccgacgtttgtgcgagtgggtaaaagaggccggtacaacgacgcagaacgcaccactggcggtggataccgccctcaatggtgaggcatataaacaacaggttgcgcgcgccgttgcggagatccgccgtggcgagtatgtcaaagtgattgtctcgcgcgccattcccctgccatcgcggattgatatgcccgccacgctgttatacgggcggcaggcaaacacacctgtgcgctcgtttatgttccgtcaggaaggacgcgaagcgctgggctttagcccggaactggtgatgtcagtgacgggcaataaagtggtcactgaaccgcttgcgggcacccgcgatcgcatgggaaacccggagcataataaggcgaaagaggcagaactgctgcacgacagtaaagaggtgcttgagcatatcctttctgtcaaagaagctattgctgaactggaggccgtttgccagccgggcagcgtggtggttgaagatttaatgtcggttcgccagcgcggcagcgttcagcatctggggtctggcgtgagcggtcagcttgcggaaaacaaggatgcctgggatgcgtttaccgtgctgtttccgtcgattaccgcctcaggtatccctaaaaatgctgctctgaacgcgattatgcaaattgagaagacgccgcgagagctttattccggcgcaatcctgctgctggacgatacgcgctttgatgcagcgctagttctgcgttccgtatttcaggatagccagcgctgctggatacaggcgggggcgggaatcatcgcgcaatctacgccggaacgcgaactgacagaaacccgggagaaattagcgagcattgcgccctatttaatggtgtaggagtaactgttttctaacctcacaaccagactgtccaaagacaattgagtcgctctttgattcctctgtgactctattgtcttcttttgggataaaataggtgtttttcgtcatgaagttgataaaagtctatatagaaccacctcctgtggaggtggtggtaatttgccagagtgtgggattcgttagtatattatgggataaacttatttttaccaattgtataaggcggtgcataagattctcggcatgcttccagataatccgaccaccactgcatcatcgctttgcgggcttctaggtgctctgccttatgaatataagccatgcgcacggtattgcgctcctgatgactcatctggcgttctactgcgtcctttgcccataaacccgattccatcagcgcactgcatgccattgcccggaagccgtgaccgcagatatcctttttcgtgtcgtaacccatcacccgcagtgccttattgaccgtgttttcagacattggcttatacgggttatggtcgccggggaagatcagttcattattaccggtgatatccttaatctgtttcagaatggcgatggactgttctgagagggggacgatatgcggcattcgcatttttgccccgcggccggaataacgcacgccaataatgggttctcgcgtcgcgggtatcgtccagactcggtttgtgaaatcaatctctgaccagcgggcgaaacgcagttcactggagcgaatgaacacatgcagcatcagcagaacggcatgccgggtcagttcacggccctgatgatatgccccaatacgttcaagcagttcaggcagccgctccagcggcagggcaggatagtgccgtctgacaggaggtgtggtcacgccgccaaggtttgctgcagggttcgtatcgattaactcctgatggaccgcatggcgcattatgttactcaggtgctgccgtgtgcgggacgcaacctccagcagacctttttcctcgatccctttcagcaggtcaatgaaatgacggggtttaagttctgatacaggtaggttcccgatgaccggaaagatgtgattgttcaggctggcaagcagacggtcggcggtgttctgcgaccatttcctgttacttttatgccacgccagcgccacgtttttaaaaactttctccggtgttcgtgagccacgttcagcagcccgctgctgtaccgggttgatattcagcgccagcattttacggataccttcacgttgctgtcgcgcatcagacagggagatggctggataggcacccagcgcaatgcgggattctttaccgctaatacggtatttgagataccagtggcgggagccacccggcttaaccagcagatacagaccgtgagaatcggagactttaaagggtttatcagaaggcttgagggtgcggatttttgcgtcggtaagggacatatgggggtcactccattatcgaactaacctgaccccagatttgaccaccaatttttcccgatgcgtagggtaaaatcaaaatgcaccgagaagagttttcacactaacctgttgaatcaacatcagataaagattcgcaaggatgcatgaaaacagaaaattggctcctctgactggactcgaaccagtgacatacggattaacagtccgccgttctaccgactgaactacagaggaatcgtgtgaacggggcgcatattaatggcagtgcatggtgatgtcaaagggtgaaatgcatttttttgtttgtttgctgtcaatttcaacaaagtggtgagctttcaatcttattggtaatgaaccatcgtggtgcataccccccttttatggggcaggggaacgcgacagctgataaaaagagccaatgacgaatctatcataatctcttatttgacagttggttagcttgtacatcaacgccaaaataaaactggcaagcatcttgcaatctggttgtaagtaatggcggcacttgggccgattcttataaaccggaggcaacatgaacttcagacgcctgaaatacttcgtaaaaattgtagatattggtagcctgacccaggctgctgaagtattgcatatcgcacaaccagcgctcagtcagcaggttgccacactggaaggtgagttaaatcaacaacttttgattcgcacaaaacggggcgttacgccaactgacgccggaaaaattctctatacccatgcgcgggccattttacgtcagtgtgagcaggcccaactggcggtgcataacgttggtcaggcattatcggggcaagtctcgattggctttgcgccaggaaccgctgcgtcatccatcaccatgcccttattacaggcggttcgcgctgaattcccggaggtcgttatctatcttcatgaaaatagcggtgcagtgcttaacggaaaactgataaatcaccaactcgatatggcggtgatttatgagcattcccctgtggctggtgtatccagtcaggctttactgaaagaagatctttttctggtaggaactcaagattgcccggggcaaagcgttgatgttaatgctattgcgcaaatgaacctctttctccccagtgattacagtgctgttagacttcgtgttgatgaggctttttccctacggcggctcacggcaaaagtcattggtgaaattgagtctattgccacgcttaccgcagccattgcaagcggcatgggcgttgcagtattacccgaatcggccgcgcgttcgttatgtggcgcagtaaacggatggatgtcacgcattaccacaccttcaatgagtctctctttgtcattaaatttacccgccagagcgaacttatcgccacaggcacaggcagtgaaagagttgttaatgtcagtgatgagttctccagtgatggaaaaaaggcagtggcaattggtgagttaagcgttatatcgggatggaataagatgcgggtttttattatttgttatgccgggcattagactttaacaataacgggatatctgaactgcccggagtttaccgtgaatttccaacaactaaagataatccgcgaggctgcacgtcaggattacaacctgacagaggttgcgaatatgctttttacctcacagtcaggcgtcagccgtcacatacgggaactggaggatgaacttggcatcgaaatatttgttcgacgaggtaagcgactgctgggcatgactgaaccgggcaaagcattactggtcattgcagaacgtattctgaatgaagccagtaatgttcgtcggcttgcagacctgtttaccaacgatacgtctggcgttctcactattgcaacgacgcatactcaggcacgttatagcttgcctgaggtcattaaagcttttcgcgaacttttcccggaggttcggctggagctaatccagggtacaccacaggaaattgcgacgttgttgcaaaatggcgaagctgatattggtatcgccagcgagcgtttaagtaatgacccgcagctcgtcgccttcccgtggtttcgttggcaccatagtttgcttgttccactcgatcatcccttgacgcaaattacaccgttgacgctggaatcaatagcgaagtggccgttaattacttaccgacaggggattacggggcgctcacgtattgatgacgcatttgtccgcaaaggtttgctggcagatattgtattaagtgcgcaggattctgatgtcattaaaacctatgttgcactcgggctggggatcggattagttgccgaacaatccagtggtgaacaagaggaaaagaatttaatccgtctggatacgcggcatcttttcgatgctaatactgtctggttgggactgaagcgagggcaacttcaacgtaactatgtctggcgctttctggaactttgtaatgcaggactgtcagttgaggatatcaagcgccaggtgatggagaacagtgaagaggaaattgattatcagatatagcaaaaagcccgctataaaagcgggcttttcagaaatttggctcctctgactggactcgaaccagtgacatacggattaacagtccgccgttctaccgactgaactacagaggaatcgctgttgaggcacatcttaacggcgaaaaatcttttgtcaaacccgatttttaaatttcccaaccgtttgccgtttctatcaacagtttgttgcatttgcagacaatttgttggcgaaaatctttgcagctttgctgattctccctcattatttgaaatgtggtttcactttctgcaattagggtcggctttgaatatctcctctgctttacgccaggttgttcacggcactcgctggcacgctaaacgcaagagctacaaagtgttgttctggcgcgagataaccccgcttgctgttcctatcttcatggagaacgcctgtgtcctgttgatgggtgtcctgagcacttttctggtcagctggctgggaaaagatgcgatggccggcgtgggattggcggacagcttcaatatggtcattatggctttttttgcagctatcgatcttggtactactgtcgttgtggcatttagtctcggtaagcgggatcgacgacgagcgagggtggcgacgcggcagtcattggtgatcatgacgttgtttgccgtactgttggcaacgcttattcatcattttggcgaacaaatcattgatttcgtcgcgggtgatgccacgacagaagttaaagcactggcgttgacttatctggagctgacggtactcagttatccagcagctgctatcactcttattggtagcggggcacttcgtggtgcagggaatacgaaaataccgctactgattaacggtagcctgaatattcttaatattattattagcggcatattgatttacggccttttctcctggccgggactgggatttgtcggggctgggttggggttaaccatttctcgttatattggcgcagtggcaattttgtgggtgctggcgattggttttaatcctgcgctaaggatttcgttaaagagctattttaacccgctgaattttagcattatctgggaagtcatggggattggtattccagcgagtgtcgaatcagtattatttaccagtggtcggttattaacccaaatgttcgttgccgggatggggaccagtgttattgccgggaattttatcgcgttttcaattgcggctcttatcaacttacccggaagtgcgctcggctctgcttctacgatcattacaggccgaaggttgggggtagggcagatagcgcaagcagagattcagttgcggcatgtgttctggctgtccactcttggattaacggccatcgcctggctaacggctccctttgccggggttatggcatcgttttacacccaggatccacaggttaaacatgtcgttgtgattctgatttggctaaatgctttatttatgcctatttggtctgcctcatgggtgctacccgctggatttaagggtgctcgcgatgcacgttacgccatgtgggtttctatgttgagcatgtggggttgccgggttgtagtcggttatgtgctgggaatcatgcttggctggggtgtggttggtgtctggatgggaatgtttgccgactgggctgtgcgggccgtgctgttttactggcgaatggttactggacgttggctgtggaaatatcctcgacctgagccgcaaaagtgtgaaaaaaagccagttgtgtcggaataaacgacaaagtgcagattatttcagcaaacgatttcaaatttaaaaaacaggctttgacattgtggatgagcgtcgctaatattcgcctcgttctcacgattcctctgtagttcagtcggtagaacggcggactgttaatccgtatgtcactggttcgagtccagtcagaggagccaaattttagttttgagacatctctatgagtctcaagacagttaaaaaataaaaattatttttacccggttaccttgtaaaaagtgaccgggttttttgatttctgtgtttcgtgcgcttaatcgagtctcacgcttcagtgagcaaattgcccctccccaacagacatcacgattcgcaaggtcaaaaactctgttccatgaagtaccgtacaaagacaaagagaaaaatgccttatgcgggatgtcgctatcgcgtctttatcgggaaactatgcgtaattgccactttgccttctgtaatcagaaaaagaagaactggaattttaataaatattatttctctgggaatgggggggttttataagcaatatgacgagttgaatattatattttttataaggattatatgagattaaagaaatctgccataaagacagatttctttaaaatataattagagatttgcgacgttatgataaactttttgaacatcgtcgtcatcttcaagggcatcaacaagcccttcaaagatttctaaatcttctggggaaagctcaacttcagattgagcaatcatttctaattctgttgttgagaactcagtgattccagctgcttttagagccgcgattcctttatgaaggtcagtaggttcagtataaataacaatattaccttcttcttcagttacatcacgaacatcaacttcagcttcaagtaaaatttcaaaaatatggtcagggtctgttcctttaaatacaatcacacccgtattgtcaaacatatagctgacagagcctgccgctccgatattgccgccttttttattgaaaattgtgcgaacgttagcaatcgtacggttaacatttgaagtcaatgtctcagcgataatcattgagccattaggaccaaagccttcataacggccctgcacgaacgtttcatctccgccgcctttggctttatcaattgctttatcaataacgtgctttggaacttgtgcctgctttgctcgttcaataacgaattttaaagatgtgtttaattctggatcgggttcaccttgtttggcagcggcatagatttctacaccgaattttgcataaattttagacgtcgcaccgtctttagccgtttttttagcaacaatattggcccatttacgtcccactggaatgatctcctcgaaaatttatttacattactggtaaatcgttaacatgtgttaattcggcatattatatcataacaggaaaaatctcgtctattagaaataaaaatattctaaagccataatattatatttaatctcataaaaactaatgtcgttggcggatttttttataattgtgttttgaaagcatacttgcttttaatatgtggaaatcattaaggctagaataaaactcgtatccgccccaggaagcaaacagcctgctttattgcaggctatttgctggatgacttactaaatccttcacatctattcctgataaaaaggaacggaacttattaccggaacggcggctcattaaatgttcgtaatttacgtgaatgcagtcggtcgccttctgcgcgcagcaaatcgatcgcccgaatgccaatttgcaggtgttcggaaatagcgccttcataaaaacggttagcctgaccgggaagtttaatctcaccatgcaacggtttatctgaaacacacagtagtgtcccgtatggcacgcggaaacgatatccttgcgcggcaatggttgcactttccatatcaattgctacggcccggcttaagttaaaacgaagtgcagaagctgagtaacgtaattcccagttcctgtcatctgtggttaccacagtgccagtacgtagccgctgtttaacttcctcacctggcctgccgctgactaacttggtagcgtcataaagcgcacgttgcacttcagcaatgctcggaataggaatatcgggcggcagtaccgcatcaagaacgtggtcatcgcgtaaataagcgtgtgcaagtacataatctccaatggcctggctttcacgtaagccaccacagtgaccaatcatcaaccagacatccgggcgtagcaccgccagatgatcgcagatggtttttgcatttgacggtcccacgccaatattcaccagagtaataccctgaccatcggcggtaattaaatgccatgctggcatctggtgttttttccatgcaaggtcggaaatggcttcttctggcgcttcggtttcggcggtgatccagttcccgccagcacaagaaagggcaatgtagggactatcagggtcgaggatctggctgcatccccaacgaacgaattcatccacataacgtgtgtagttggtaaacaagacgaacggctgaaaatgttcaactggcgtaccggtataatggcgcaaccgcgcgagggaaaaatcgacgcggcgcgcatcaaaatgcgatagcggggagaattccgttggatgataaatgccgtctgcagtttcatcgccaatttgcgccagttctgttgtcgggaagtagcgagttaacccagcgctcattgagcgatcaagtgtcaattcagagccatcgatgacataaggataagggatttcatgctgcgagggttgcaccgagatatgcgcaccataatcctgatacagcaacgtaagttgttcattgagatacgaacgaaagagagtagggcgagtaatcgtggtggtgtagctgcctgcgtgagtaaaacgaccaaatgcgcgcgttttggggggattggttgtgctaccgtcccaggttacggtcagtgatggatagacaaaaagaccttgtttgcgggcgttttcatcaggtaattcgccacttgtaatatatttgccaatggcgttgcgtaaagcgactacagattgctcatacagcgcgtcgagtttatccagtgcctgagctggggtcagaccggagcccttattattcatgtgtgtctcctgttccatacaattaccgcacatccgatagtatgtcacaggaatgtgaaacaaaagtgtaaggcgaagatcggatgatcttcgccaggctatcaagcgcgttgattgtctttcatcaacaaagcggtcattgcggaaatcaggcatccagccagcaaataaatagcgacgctatgccagttcccggcaaagtaagtgatgagtgcagcggcaataaaaggtgtaaatccaccgccaaccacactggcaacctgataaccgactccagcgccactatagcgataactggcaccaaacatttcggtaaacatcggttgttgtacacacaccaccatatcatgcgcaatgtttgccagcatgatggagaagaaaactatccagaaaatagattgtgcttcaagcgccataaagaaaggaaatgcgctcaacgttccgaataacgcacctgtgatataaaccctgcggcgaccaaaacgatcggcaagccaggcaaaacagggaattgtcaggcagcttaatccaccgaccagcaaaccaatattaaggaaaagttcgcgcggtaaccccatattctgggttgaataattaagtgcaaaggcagtaacaatgtacatcgtcagcaactcgcacagtcgtagtgcaataatcttcaggaaagcaccgggatgtcgtaacagagcttcgataaccgggatgcgttttttcgcggccgcttgattatgttgctgttgttcaaattccgcggactcctccatgccattgcgcacccacaatgctcccagtaccagtacgatgctaaacaggaaaggaatgcgccagccccagcttaaaaactgttcgtcagtcgtcatcatactgatcaatgaaaccagtccggttgaaagcagtaaacctactccgtagccaacttgtacaccgctactgtaaaaggcttttttatttttcggcgcactttcaacggaaagcaacgctgcgcctccccattcgccgccgacggcaaatccctgaatggcacgcagtgtcaccagcaaaataggtgcccaccacccaatggtcgagaatgaaggaagaataccaatcaaggctgtcgcgatgcccatcatccagacggtcagcattaacatgcgcttacgtcccagtcggtcgccaaagtgaccgaaaatgacaccgcctagcggtcggaaaaggaagccgacaccaaaggtggcaaatgcggcgagcgttcccatcgccgggcttacttgcgggaaaaactcgcgattaaacaccagtgcggcggtaatgccatagagtaaaaaatcataccagtcgacgacggcaccagcgaaactgcctaacgcagctcgtcgggcgcgacttaacgaaagcgtcccttcatcgggacgagtggagatgagcgtggagtccataatgatcctgtttgtactgtctttttataattagtatggaaaaggtaactcacattgccgtcgatctataaacgaaccttatgagactacctcgacagagcgcatctgcaaatgattttatggctgattagcggcaacatgaaaaattcgatggaagatgaaagcacgggcgttgctggtgttgtttaaggattaagcagagcacccacaggttcgagatatgaaacataaaagtccgcatatgtacaaaatagcaccctgatgagtctgatagactgcattgcattataaccagtagggaggcgaggttaggtatgtttttagcatcattgttgagacgtattgcatttagttactacgattataaagctaataatttcaatattggaaaaacagactttgttgtcatccatattcccgatcaaattggcgatgctatggccatctttccagttattcgggcgattgaaatgcataaaataaagcatcttttaattgttacttcgactattaatttagaagtctttaatgcgctcaaacttgaacagactaaattaacattagttacaatgactatgcaggatcacgcaacattaaaagaaataaaaaatttagcgaagaacataacactgcaatacggtacgccggatctttgtatagaggcgatgcgtaaaaagaacctgaaaacgatgatatttatcagtcagttgaaagcaaaaacgaattttcaggttgttggtttaaccatgaagtgctattcccctttgtgtaaggacgcgtcccggatggatcagagtctccgggctcccgtacccatgacatgggcatttatgatgcgtgaggcgggttttccagcagtcaggccaatatatgaattgccactaagtgaggatgtactcgatgaggtgcgcgaggaaatgcgatcgttaggagcttacattgcgctcaatttagaaggtagtgcacaggaacgtacattttcattatcgatagcagaaaatctaatagcaaaaattcaaagtgaaacagatatgccaatagtgatcgttcatggaccaaaaggggaagataaagccagggaactagtgaatagttataataatgtctaccgtttatccttgtcaccctcgattaaacgttcagcagcaatcataaaagatgcttatatcgcaataactcctgacacctcaatattacatatggcaagtgcctataatacccccgttgttgcaatttatgctgattacaaaacgcgatggcccgcaatggccgatgtttcggagtcagtcgtcgttgggcaaaaaattgacaatataagtctggatgaattcgcaaaggcattaaaaagtgttttggcgagaatatgaggcagtatttatgcatattaatgccgatctgttatgaacggtggtgtcatcaatactctgtggctggtcaatcattacagaaagccagtctttggagcaaagctgtactcaccggatacaaccatagtcacaccgaacgcgaatctggcggtatcgcatttttatttattcattttctgtgagagaagggcaagttctgtagagggaatgtaaaaaagagtgccccgaatggagcactctttaaggaattatagcggaaaatcagaggtttttataacatgtcgcatgagcaaacccaagcttttcatatacactttgctcacctgttgccagagaaattacgtattgttcgcttgagtttgcgggactagatgaccaatacatatttgattgaaaaccagcttcagtcgtgtaatgccccatatctccccattcactgtacagtgacccgatgcctcgggaacgactatggtttaaatggtctccaaggggaagtgtgtagccattgctactgcaaaaattttcagcaaggctgtatatcatgaaagcatcgccggcgttcacccaccaactcttcactcggatttcgtatatatagctagggccgcctgtttttggcgtcgccgtaatcctctcccatttgctgccgacatttttaaatgtcactttaccggtagcatcaacatcgacccaggagccagagcttgaaaactcataatcagccgccgtttttcctggagcaaagttgtcattattcaactgataatacgccccggtgaatccctgcgaagggaatgtagttgttggtaggttagcaccattgaccaacactgtaccgctcattattttgtcttctgcgcgagtgaattgtattgtggtactcagacccgcttgatgaacaccattcaatacagggatcagcgttgcgataccctctccgccgcctgtaacagtggctttgtaatcaccgttgatattttgactgtaatcaattgcgctaattttcacatagggcacgttagtacctgattgcacaaattccatcccttcagaaactttgatcggattgcctgatatatcgtacaaaacaagatgtagctcagcactatcggtatagtcccctttcagtgatgaccgattgttcttaaggacggactgcgaggcgtcagccgggcctgccaccagcgttatatctactgtttgcattccaccagcggtcgtgactgcgcttaccgtgacgctacctgtcatcgctcctttcacgcttgttgtcgcgattccgttttgatcggtcaccgctgttaatgtcgttaatgtggcagagccgctttttaaggcgaagtacacagtgagaccttcgatcaggttaccactgccatcctcaaccgttgcctttaaggtacttaaatcactgttggtggcggcgatagtcgatggatcagcgataaagctagcaacatgtgcggtgcttgagttgccagtgactttcacggttgtctgtgtctgtattgttacgccgttatggaacgatgcagtcaccgtatatgtaccgactttattgctggtcagaacgactggtgcctgacctgaagagttggttctcacttttccgccacttaacgttgcaccttctggcgttacgctaaagttgatgacctgaccttccactggagtgccatttgcagaagttagcgttgccgtcagagttgcacctgttggggaattgacaccgataagcgggctggacgccgtgagtgtcagtttttcatcaatagcctccagttgtttctcaattgaggctccattcgccagggatgctttcaccatatacgaaccgtttctttcgggcgtcatggtgacctcggctataccctgcgtattagtagacaccgtattctggctgatgatcatttgcgaggatggctctgcactgaatgtcacgggttgatgcgcaaccgggttgccaaactggtcgttaacgtgagctttaactgctacgtcttgtgcgaccattacctgaccttcaggtatctccagactggtaaacgtcgcagaattaacatctgcactggcattcagtaatcgcgagatgacttcagtaggtttatctgccagagaggctgaaactgttttcagtccgacctcggtgcttgtcacaagaatttcagcgaatccctgactatccgtttcaacgctggtgctgcttagcgtgacggaggttccgcggaaattaacttttatgccttctaccgggttgccgttagcgtcagtgacgcttgccgtcatggttgcgccctcggtcgtgctgacgacgaatgagtatacagaggttaaggaggtcagttttgcggtaccagcatcggcaatcaacgtcacctgtttcgtatcactgacaccataattgttcacgctaactgtcacggggtaggtgccggattttgtaccgctcagtgtaacttcagccttgccgttgatgtctgtaatggcggaaccgccttgtccgagagtgaagcttgcgctcacatctgccggtagcgtgaatgtcaccgcctcattggctaacgggttgccgtttccatcagtcactgttgcctgaagtgtggtcatcccaacgttattggcgataaagttgtcctcggtaacgttaagattaacctgcgcagtgagcgtatccgcagtaaagttcaccaccagttgtccgctcttaccgccagccatcgatgctgtaacagtatgagcgcctgcttttgtacctttcagcgtgactttcgctttgccttcagtatccgtaatcgctttaccgccatcgctcagcgtgaagttcgccctcacatcttccggcagagtaaatgttacctcagtgttggctatcgcattgccctctgtatcagcgactgttgctgtgagtgtcgtgagatcgttattgtcggcaatcaccggatccttagaggctgccagcgagatttcagcattcgcgacgttcggcacataggtcactgtttgttgcatcgaatcaccattttcgagggttgccgtcacttgataaaccccggcttttgtagcggtaaagcttgcgtaaaaattgccgtagtagttggtagtatatataccgttattactgggggtcacgccttcacttggtgaaacgctgagggtcacctgatgctgggggacaccgttgccgtaattatccttcacctcaatatacagactggttgtctcgcctgcggagactgtatcaaaaagtgcatgtagcaaagtgaggtgtgccgtagacgcatcagcattgacattaattgatgtgctaagcgtggagctaccattttccagactggcctcaacggtatctggtctcgctcctgattctatcgaggagcgggtattggtataagtgacggtagccttaccctgttcgttcgttacggcttggccgccattcgtcatttcggcagagtttgttctgctggtgaagttcacagtcacacctttcaccggaaagccattattatcaacgactgtggcggtaatgacgctgccggtgctgttctgcggggtaccggcgaatatgctgtctgggacaggcgtcaactcgataatttttgccgccgctgtgtcgccaataaaatgcacagttttgttgtcgctggcaccagtattagccagtgatgcagtaacagtctgctcaccaaaggcaacgcctgcgagagtggcctgcgcgatgccagactcattggtattactttcccctggggtcagggtgaggcctgaagaagctgtgctgaatgttaccggaagattgttcacctcattgtcgaactgatctttgaccgttgcagttagcgttgcgctatcgacgccattacctgttatctcattttttgatatctgcaggacaacctgagccgaggttttgtccgccacaaacgttaccggctgcgaatcactggtattgttattactcagcgttacggtaaccgtatgcgtgcccgcttttttgcctttgagggtgacatgcgcttcgccattggcctgagtgatggcaataccgttattttcgagggtaaagtttgccgcaacgtcctgtggcatggtgaagttcaccgttattcccgccaccggatgattcgacggatctttcaccgttgccgtcagctgcacgctgtcgctgttattcgtcaccacctgttgagcagggatattcagcgtgacctgcgcgttgctggcatcgggcgcaatattgactgtcttcgtatcgttgttgccgttaggcagtgtggcttcggctgtatgaacacccaaaaccgtgcccttaagggtaacttcagcaacaccactgtcgtttgtattgctcgtgctctgactaagttgtgtatcagccgggttagtactaaaggtgaccggtagatctattactacgttatcaaaaggatctttcactgttgctgtcagcgttgtctcatccacgccattcccaatgatttccgctttcgaggtttgcagaacgacaactgcgctgtccttatccgccacgaatgtgactggctgcgcatcgctggcattattgttacccagcgttgcggtaaccgtatgcgtgcccgcttttttacctttgagcgtgacatgcgcttccccattggcctgagtgatggcaataccgttattttcgagggtaaagtttgccgcaacgtcctgtggcatggtgaagttcaccgttattcccgccaccggatgattcgacggatctttcaccgttgccgtcagctgcacgctgtcgctgttattcgtcaccacctgttgagcagggatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgccgtcagctgcacgctgtcgctgttattcgtcaccacctgttgagcagggatgttcagggtgacctgcgcgttgctggtatcgggcgcaatattgactgtcttcgtatctctattgccgttaagcagtatggcttcggctgtatgaacacccaaaaccgtgcccttaagggtaacttcagcaataccgttctcattagtattacgcgtgttcagactcagttgcgtgtctgcgggggaggtgcggaagactactgacagatttttaaccacgttatcaaaaggatcttttactgttgctgtcagcgtcgtctcatccacgccattcccaatgatttccgctttcgatgtttgcagaacgacaactgcgctgtctttatccgccacaaacgtcattggctgtgtatcgctgacattgctgttagccagacgagccgtgatcatatgcgtgcccgctaacgtgccggtcagggaggcgattgcaaccccgttactatccgtcatgccttttccgccgttactaatcgagaaccgacttgcgacgtcgtttggcacagtgaaggtgatttctttatcttttagtgggttgccatttttatcctgcaaggttgcagtcatatgttgcggagctgtgttggtgacggtgatatcacctgaaggcacactgagggtcagggcagcagtactttgatcaccgataaaattcacctgttgattggcctgggaaccagagctcacagaggccgtaactctataatcaccgttttttaaactggtcagcgtagctgtggcgatcccgtcgtggctattcacttcggtttggctcagtttcgcctctgctgaattaacattgaaggtgaccttgacgtcattgagcaggttgccttttgcatcccggactgtcgcggtcattgtggcgctgtcattgccgtcagcgaccacttcatttttcgacttctgcagatcaacctgtgcggtacttgagtcaccgacaaaactgacgattaacgtttgtttcacgccattttcaagggtgacttcaaccgtgttgtcttcctgcttactacttttcagatcaaaagtcgccagaccattaacatccgtttttgcggtgttttgattgttgaaggaagttgccgatccgtttaataccgcaaacgtgacggtatgatcattgattgggttgcttccctcatcagcgacattgaccgagacggtgtttgctgcattctcattggcgagcacaccattattgctggcagataatgtcgcaattttcgctgactgcgggttggcgtcgatgataaatccagcggtatgcaaatcttcattccagttttgcattaacagcttcgcagtaagcccactgcctttggtataggcggtataggtcgccttatagacgccatctgcggtttctttccagtcagtagtgactcctggtttcacgttgtcgatgctgactgcagtattcagttgctgtttttgctccttaacaggtttgtcattttcatctcttagttctaccgtcacctcgataggattgccggagagataacggtccttatcaatcttaattgacgagtgagttcgggatgacgaaacagaaatgatattcaccacggcgggggctttagctgcatctacaccgttcagctgtggcatcagcgttagcgtgccagacatcgctcctgtggtcaggacttgggtatagcttccgtcaccattatctttccagtcagaaagggtgatgtcctgaacaccttcgtgacgcgtcgagagcaccagcccgataacaggattaccagctgcatcatgagcaataaaagtcagtgtggcggttgaatgggaatccgcactcaatgtttgggtacttaacgataccgaggaatctttctggcttagcgcaggtgcctgaacgaccaccatgctttgttcacgattcgaaaaattgcctttgacatcttcagcggtgacttcaatcggccaggtgttatcggtttctggcgtactggtgaaccggtaacccggcagggtaaccagaatatctttacccgttgtgaccactttaccaccggcagcttccagagcggtggcttcgacgttatagcctttcagggcatatttggtttgtagcgatgaaaccagtgatttcacttctcctgacttccctgtcacggggtctgtcagggtcaggcgaaccagttcttttttgcgatattccagaacgatgttgttgttgcgatccaccagatcataacggctgcctgcaaggctacgccgtgcagcgacttcgttcgggtcaagctgtttctgcattgcgctgccaggttgccaggtaaaatcgacggcaaaacgggtgtcattttcgccctgtttaccctggcgttgctccgcgctgaaggtcatcagcgggaagggggtatagttaagtccagcggttatggcatgaggattactttgccgatcgtctttatcgaacagggccacttcatcgccataatactgttcatagaccagtttaccgccaaggtgcggccaggcgggtagccagccttctgcgcgtacatcccagccattggccgggcgtgcttcataatcgttgtccagttcaggtgcgctgcgccagttggtcagtcgcaaatagccgttactgcttaattttagatagtcgcgccagtactctgcgccaatgccggcgcgggagtggtaacggctaaggtcgtggtcgaaaaagaagttgatgcccgacatccatgtgggagtgaaatgacgccaacccaagccgttgttaatttgcgtacgctcgtcagtacgatggagagtatgctgactgaaaaagagattatcaggcgtttcatacctcgggtggagaaaatcgaactgggagttcttcaggctaaaatcttcatccacgcccagcgtgattcttgcggtaccgaagcggcttaaccagtctgtcattacccctgaagcctgagaagaggcccatccacgcgccatgtttgccgcttgctcgctgttcatatcttcggcgagcaaagacccgatttgctgtgaagtactggctatctgttgctcgaggttgtcactgctattacccggcggcggggttaattttttttcactaacttgtgccgggacatccagttcatcaccctggcggacattatcaaaacctcgagcaaacgtacgaaattggttgagtttgcgtaactcagccaccgaaataccgaaacgttcggcaacgctttgggccgattccagcgctccaaggatgtagggcaccgtattggcatttgcaatggcgatttgtgcaggaactggttgtggggttgcggcgtttaccacaccttgtgctgccgcagccatagggaacgcaagttgagttaccaggcagatacccgcagttaagcggcgtagtttaattcccatcccgcataaaatttgtctgtcatttatttcttctccacttctcttcttcgtagccatgcttaccttccctgaacgagctaacataaatgcgccctttctagcacagcgaaaaaatataaatcctgatagcaatatgattgaaaattaataacttttcgttaggcagttttgggtgtgagttgcaagaggggagactactgaattactcaagttttataatcgaggggaaaatggtgatggcgtccatagcaaaacgccctcaaccataaaggtcgagggcgcttaagatgtcaaaaacccgctatccgttaaaaagcaatgctcaactaaggtcagtgacattgcgctaaaaagcaaatttttagaatttggctcctctgactggactcgaaccagtgacatacggattaacagtccgccgttctaccgactgaactacagaggaatcgtgtgaacggggcgcatattacttagcggtaccttgtctgtcaacactaaatttcataagtcatttcaattggttaattaatctgcaaagttgttaattaatgaacattcgtcgtcgaaaacgagtctgtatcattagcgtggtgcagtctctgcaaaggatcttgttgataaaattggcagaaacgttgccacaatgaagggaaacgaggagcaaaaagttctggggcgctaaagaaatattcagaaagtacggcaaaacattcagcaggatcactggcagcataagcatcaatgctcgccgcattctcgccaaccaattcgatttcttcctgaatgttgttcattgcagcatgaagatcgtattcccagccagcaacctcacgcaacggaataaagggaactccgctggcgcgatcgccgttacgggtgtccagcttatgagcgacttcatgaataatcaggttaaaaccagaagcatcaaaagaatcttgtatatccaaccagttcaaaacgataggcccttgctgccagctctgacctgactgaacaatacgttggttatgcaccagaccgatatcgtcttcccattcatcatcgaccacaaatggcgcaggataaattaagacttcatgaaaaccatccagccattccagtcctaactccagaacgggcaggcaaaatagaagtgctatccggcagcttcttaatgaatccagttcaaagccctgtaaaggaagaagccgcttttgctgtaaaaaacgttcggcaagagtgactaatttgctttgttcctgttccgtcagacacgttaaaagggggatcgatagtgcttcctgccagggaagggcagtttgatgtgctgattcttgtactttccagggccacttaatcatcgttttgctcgcaaactcgtcacttgaacaaaattgcacggacagggactgttaaaatgccaaatttcctggcatcatggcaaccatctgaacggagagatgccggagcggctgaacggaccggtctcgaaaaccggagtaggggcaactctaccgggggttcaaatccccctctctccgccactttatcaatgacttatctcccgacttcccgccttgcttttcctaaacagaacaatcgtagaatattcttgaagggttagatcgtcactgttttctgttcgatactgtgacattcagcacttgattcgctatggatctgacaggaaggtttcgagcgaaaatctgcaattattcagtcgttttcttatcggtcaccattattcttttagacattgatcctacaaagctgccgcaaagttggtggtgggaactgaagttgcgtagagaaggggtcaataattgagcaaaaaaaggaacgcggccgtcagattaaagccgcgggacaaagtccataatttccaagagttgttgaatttcccagcttttttgaaagcctttgtatcatactaacaagtaaaaaaaggtttaaataccaaaattaacctatatttctggttagctttaccatgacagatgacttgctcctggagacattggcgcagccagtctgtattggtgagttgtgtatttattgttcgccgttttctcagtttttttctacagacataataaaaaagacacgtctcaagcatgagcgtgtctgagtttgttttatttatttgtcttggtaaattattgtcgttactaccaggcactgttctgttaaataattgaagtcagcgcaaaaaaatcaatgagacatcatttcctcgaccacttcttcgctactcaactgatagggataatacgttggccagttttccatttcatttaataaagattgctgtgaatcattacccataaaaatgtgaaaatgagatgattttcgtggtgcaattatatgatcgctaaattgtatatatttaggggctttgctttcaggatctttacattcgaataagtaacgaacgcctttcttgcctgatttataggtgagtattttgtatccatcgtaatcatatttacaggatgttgtttcattatttctatggaattcaacaatgccgtcctcaatgccaatcatctcgatatctgttgcataacctttgtgataataatctttaatttcagcaaatgttttagttttatctgcatccgctttcttctgaaagacggggtcaagcttgccactttgcagtaaaggataaacggattgccagactccatcccagtcacttagcgttcggttttgtacattggcatcatcaaaaacaccattagcagctttttgttcgacctctgttaagggtttgccgtgtgagtgatgaccatgcgaaaaggcaggagcgctaacaataaagacacctaaagcaacagccagtttgtgaagacgaatcgccaaaacagtttcctccagagtcattgtatatgatgtgtaatgttatattgtaacatatgacaaaatgcaacaactcttaggagatgagagcatagttttctcaggtgtacttatctatcttattgaaataaaatgaattatgctgataatttgagtttgatgacaaacgaaacataacctgatgcgatctgcgtaggccggatagggcgctcgcgccgcatccggcagggataacgcgtactttgtcggcaatatgaagttatagagataatttgttgtgaacctgcttgcgtaaccggttgaaaagggaaagcaacttcttataccgtaaggctaaaagcagtaccgccagcccagcgtagatgagtggctgcggtgaaataatcttcactgaccacagataatgtattggggccaggatcacgacaagatagacgaagttatgcaactgttgccagtgtttgccgagttttcgctgcatcgcctgggttgaagtgaacgctaaagcaagcaaaataacccagctgataattcctaacgttaaataaggccgggtaattaactccttacctaataacgccagattattcacgcccagctccagtaatgcgtaactggttaaatgcagtgtcgcccaggcaaagcaccataagcctaacaggcggcgagtgcgtatcaataacggctgttttgcgtagcgtgccagaggtgtgattaacaaggtcgccagcaaaaatttcagtgcagtgcgaccagtaaaatgctgaatatctttcaccggatcggcacccaatccaccgtgattaatcgcccagaccagccagagaaacggcaacaatccggcaagatgcaggcaaactttcagccatgtcacctgttttgctgtcagacgcatttagaaattctcccgcaaatccaggccacgatacagcgatgccacctggtcggcgtaaccattaaacagtagcgttggctggcgctgtacatcgaggatgccgcctgaaccaataaatcgttcggtagcctgtgaccagcgcgggtgatcaacatgcggattaacgttggcgtaaaaaccgtattcgtcaggcgctgccagattccaggtggttggcggacactcgcgggtcagcttaatactgactatcgatttaatccctttaaagccatatttccacggcacaatcagtcgcaccggcgcgccattttgtggcggtaacgccttgccataaacacccacggtcatcagtgtgagcggatgcattgcttcgtcgagacgcaatccttcgacataaggatatttcagcccgccgccgataaagcggtcctgctggccaggcatctgttccggtgcataaattgtttcgaaagcgacatacttcgcattgctggtgggttcggcaagcgccagcaatttgtgcagcggaaaaccaatccacggcaccaccatcgaccatgcttctacgcagcgcatacgataaatacgctcttccagcgggaagcgacgggttaaatcatcgtgatcgagggtcaatggttttgccacttcgccgctgattttcaatgtccatggatcggttttcaggctaccagcattagcggcgggatcggctttatccagcccgaattcatagaagttgttataaccggagactttatctgctggcgtcagtggcaggtcattttgccaggcggcaggcttgctgaactccaacggttttccggcgggggcgggtggacgatcattccctttaaaccagctaagcagatcggcatgcgcagcgtgaggcaaagaaagtgcagccgcgctgatgcccagtgcttttaacacctgccgacgcttcataaagaataccgactcggccgtaacatctgattcttttaaaaattgattctttttcataagccatcacacttttttgtcgttagccagcaagagccgtttactgttaatctgtcagggagccacctccctaacagtagcagagatctgcttttatatatttatgcattaactgccacgataggttgaatacccatattggctaagtaataaaggcacatgataatgctcgttcactttattgatatgaaattcaacggggatctcagggaagaaactttcaagattttgtttcttgaaatagtccccggttttaaatacgacacggtaatcgcccgtagttgcagtttgctcgggccacagtgccttaattcgtccatccttatctgttttggcggtattaagttgtaaccagccgttgtccgctttcttttcaagagtgactgtcacgtcggcagcgggttttcctgtttgctggttcaaaatgtgcacgctaagaatgttttgttgtgcagcatagaccaaagaaggtaatgaaaatgcagccgttactacggagagtactaaataacgctttaacatgtttatatccttgtcatgtgaatgagttttgaggatagcgaaaaaacgtccagggtaaccttacagcagcattacaattttgtaatgaaccaggctgtttctataacatatgatttatggcatattattttcatgaagattttacttattgaagataatcaaaggacccaggagtgggtaacgcaggggctttccgaagcgggttatgtcattgatgccgtttctgatggcagagatgggctttatcttgcgctgaaggatgattatgcattgatcattctggatattatgcttccgggtatggatggctggcagatcttacaaacgttaagaacagcaaagcaaacccctgttatttgccttactgcaagggattctgtcgatgacagagtcagagggctggacagtggagcaaatgattatctggtaaaacctttttcattttctgagttgctggcaagggttcgggcacaattaaggcaacatcatgctttgaattcaacattagaaatcagtggcttaagaatggactctgttagtcaaagtgtgagcagggacaatatcagtattacactgacgcgcaaggagtttcagttactttggctactggcctccagagctggcgaaattatacccagaacggttattgcgagtgaaatttggggaatcaactttgatagtgataccaatacggtggacgtcgccattcgcaggctccgcgcaaaagttgatgatccttttcctgaaaagctaatcgccacaatccgggggatgggctattcattcgtagcggtaaaaaaataatgaaaagattatctataaccgtccgtttaaccttgctttttatattggtgctgtctgttgctggcgctggaattgtctggactctctataatggcctggcaagtgagttgaaatggcgcgatgatacaacactcattaaccggacagcgcagatcaagcagttgttaattgatggggtaaatccagatacgttacctgtgtactttaaccggatgatggatgttagtcaggatatcttgatcattcatggtgatagcatcaacaaaattgttaaccggacgaatgtcagtgatgacatgttaaataacatacctgctactgagacaatcagcgcagctggcatttacagaagcattattaatgatacagagatagatgctttacgaattaatattgatgaagtttcgccatcattaacggttactgtggctaaattggcttcagccagacataacatgcttgaacagtataaaattaatagcattataatttgcattgtcgccattatactttgctcagtattaagtccgctgttaatcagaacggggttacgagagatcaaaaagttgagtggtgtaacggaagcgctgaattataacgataaccgggagcctgttgaggttagcgcattaccgagagaactaaaacctcttgggcaggcgttgaataaaatgcaccaagccttagtcaaagattttgaacgcctaagtcaatttgctgacgatctcgctcatgaacttagaacgccaattaatgcattactgggtcagaatcaggttacgctcagtcaaaccagaagtatcgctgaatatcaaaaaacaattgccggaaacattgaagagctggaaaatatttcgcggttaacagagaacatactgtttcttgccagggcagataaaaataatgttttggtgaaactggactcgctttctctcaataaggaagtcgaaaatttgttggactatcttgaatacctttcagacgagaaagagatttgctttaaggtcgagtgcaatcagcaaatttttgcggataaaattttactgcaacgaatgttatcgaatcttattgttaacgctattcgatattcaccagaaaaatcgcgcattcttataaccagttttcttgataccaacggctctcttaatattgatatcgccagccctggaacgaaaattaatgagcctgaaaaactcttccgtagattttggcgcggagataattcgcgtcattccgtaggtcagggacttggtctttctttagtcaaagcgattgccgaattgcatggaggaagtgctacgtatcactatctcaataagcttaatgtgttccggattacgttaccgcaaagaaattaacatagggtttcagtacgccataaattaaccgtgaaaaaacgcagccacgtcgtgagtactaacgcagctgcgattgattatgcgcttacattcaaacgtaacagggattaacccgcgtaagctgccagcatttcctgcgccgccagtttacccaacgcattcgctgcgaaaggactgtcgccggtgagaactttacggtccttatgtactcgcccggtgatgtcgtcattaataatgttcatgcccattttcttcagctcttcgccgaagtaccaggtgagatgacccggcatatagcctatctctggcgtttgtttgtctgcggcgtctgggaatgcgcaaatggaataaccattcagtgggttatcgccgtggcgaagcgccagaaaagccgccgggccgtggcaaagggagataacaaaacggtcatttttgattgcccactgtaaagcggcagccacgtcctggctttcaggtaaaccaataagtgcgccatgaccaccaggaacaaagattgctgcatattcgctgtctgcgttgaggctggcgacaacatccgcgagtttcttcggattgcggaacaacgatttatgctgctcaaagaatggcattactttttcatctttgtgcggcatagcccagtattcaaacttggtcatcagaccggaaatggtcgccacttcgaattcgaaacctgcagcgtggagatgatacaacggcagcaacgtttcaatcggatggttaccggtcgagaacagttttccgttatcggtcggcaaataacgttcgtccgcggcgatcaccagaattttatgtttaccgcgatacggttttggatagtccacgccatcaagatcagagacaggactggtatattggctaagcgaatattctgaagggaagaatgcattatcttcagcaatatcgacctgcggatttttacttgtttgaacagtcatagtgtattccttattgttgcttagttagggtagtcactatatttgcgactgagctggtcgctatttttaaccaggctggaaaattgagtcaatatatcgaaagcggtagtcggcgggtgtaagtatgtaatgatgatgctgcactggtgttgaatattattcacgccaaattttccttattgagctacgtcgtcgcaagtggcctcaatgattttagaccattatcagaggtacggggcggcggggagagatttagtgctgtggaatatcgtggtgctgatgaatatttatatcccggattggcagagaaaaagcttttttcatgcactatttttgcaaatatttctatatggggggcggttttgttgcagattaattcataaagaaatgcatttgggtcttggtttgaagagtagctggttgatgttattgtgccaggtggtgcaggataaggggctgtatcgatatgctttggcaattgcgtgtgccgcagatggagatgaaatgccaataaaaaagcctgagttcgatgagggacgaactcaggctattcttaagttttacagtaacacgccgcggcgcgttggctgattagaactggtagactaagcccacagcaacgatatcatcggtagcgatgccgttagcttcgtagaagtcgtcgtcgttgtccagcaggttgattttgtaatcaacataggtggacatgtttttgttgaagtagtaggtcgcaccaatatcaacgtatttaaccagatctttattggtgtaacgtgggtcgccgttgccgtcatgagcccaaccgcctaaatccttacctttagattgcaagtaagcgatggacgggcgcagaccgaagtcgaactgatactgagcaacaacttcaaagttttgggttttgttagcgatcgcatcagctttaccgtaaccagtcatgttacgggtttcagcatacatagctgctaagtaaacattattagcgtcgtacttagcaccaacggtccatgcttctgctgtttcaccgccagctgttgtatcggagcggtctccgtcacgagtattatgccaacctttgtgaacctgattgtcggtacggtcagagttagagtaagcagcgcccagacttaaaccaaagtcaaagtcataggaagtggacataccgaagccgtcgccgttctctttagctaacttacggccattaccgttaccagaaccttcctgaccgaataatccatcatcttcattattaccctgatattgcagagcaaagttcaggccatcgacctgaccaaagaagccattgttacggtaggttgcaacaccattagcacgaccgttcatgaagttgtcggcaccagcataggtatcgccaccaaattctggcagcatatcggtccatgcttcgatgtcatatacgacaccgtagttacgaccatagtcgaaagtaccattctgaccaaagcctaaacctgcaaatgccagacgcgttgcggtattacctttgtcgctttcaggaccgtttgcgccaatgttaaattcccactgaccataaccagtgaattggtcagcgatctgagtttcacctttgaaaccgatacgggcatatgacatgtcgccatcgctgccagcatcatcagagaagtagtgcaggcccgctacttttccgtacaaatccagtttattaccatctttattatagacttcagccgcatttgctgcgccagcaactaataacgccgggaccagcattgccagaacttttcttttcattatgtattcccttgtgattataatcttcatgaatatatcaataagtgccgttatccaaaaaaaagcacatttggatactattctatgaagttcattttattttaaagattacatgtaacaaatgtatttaaaagatttcaaaatgtttccaatctatttaatataattcaaaattatgaattctaaatataaatattcatgaaaattataaatgcatatcaatatgttatgagttgagcgaaaacataggaggtatcaatgattgttgcgccaaacggctggtgtgatcacgcgcacattaatgaaggcataaaaaaagccggcatcatgccggcccaaaaaatataaacaagacgataaaaggctaataacggaggcatcatgacacagaataataaaaaggtataattgtaatcagtgctaatatattgattgaatgaattaataaagccgatatcaaagataaataaaatcgctcaaaacgatttttcctgtactcactgccgttgcgcaaaaattatctatttgttcaaaaaatgattgagtcttgactggctcatccaatgtggaaaaatgtgacttttatcacataatagtactaagtctgaattttccgggttatctcaaaatggaatacggttcgacaaagatggaagagagactctctcgcagccctggcggcaaattggctttgtgggctttctatacatggtgtggctatttcgtctgggcaatggcgcgttacatctgggtgatgagccggatccctgatgccccggtgtcgggatttgaaagcgatttaggctctaccgcgggaaagtggttaggggcactggtcggatttttatttatggctctggtcggggcattgttaggcagcattgcctggtacacccgacctcgtcccgcacgtagcagacgctatgaataaaaactgctaaggttgcgactctttggcaacggagcgcgtatggacttacaacactggcaggcacagttcgaaaactggttgaaaaaccatcatcagcaccaggacgcggcccatgacgtgtgtcattttcgccgcgtctgggctacggcacagaagctggcggcagatgacgatgtcgatatgctggtgattttaaccgcttgttattttcacgatattgtgagcctggcgaaaaatcatccacaacggcagcgttcttcaatcctggcggcagaagagacgcgtcgcctgctccgtgaagagttcgtgcaatttccggcggagaaaatcgaggccgtttgtcatgccattgccgctcacagtttcagcgcgcaaatcgcccccttaacaacggaagctaaaatcgtccaggatgcggatcggctggaagccctgggggcgattggcctggcgcgcgtgtttgccgtttcaggggcattgggcgtggcgctgtttgatggcgaagatccgttcgcacagcatcgcccgcttgatgataaacgctacgcgctggatcatttccagactaagttgctgaagctaccgcaaaccatgcaaaccgcaagaggcaagcagctggcgcagcacaacgcgcaatttttagtcgagtttatggcgaagctcagtgccgaactggcgggggagaatgaaggtgtcgatcacaaggtgatagatgcgttttcacccgcgggctgagcgcgtggccctaaatggctgtaattatgttaacctgtcggccatctcagatggccggttaaatctatgcaggaaaatatatcagtaaccgattcatacagcaccgggaatgccgcacaggcaatgctggagaaactgctgcaaatttatgatgctaaaacgctggtggcgcagcttaatggtgtgggtgagaatcactggagcgcggcaattttaaaacgtgcgctggcgaatgactcggcatggcaccgtttaagtgagaaagagttcgcccatctgcaaacgttgctacccaaaccaccggcacatcatccgcattatgcgtttcgctttatcgatctgtttgccggaattggcggcatccgtcgcggttttgaatcgattggcggacagtgcgtgtttaccagcgaatggaacaaacatgcggtacgcacttataaagccaatcattattgcgacccggcgacgcatcattttaatgaagatatccgcgacatcaccctcagccataaagaaggcgtgagtgatgaggcggcggcggaacatattcgtcaacacattcctgaacacgatgtattactggcgggttttccttgtcagccattttcgctggctggcgtatcgaaaaagaactcgctcgggcgggcgcacggttttgcctgtgatacccagggcacgctgttctttgatgtggtgcgtattatcgacgcgcgtcgaccggcgatttttgtgctcgaaaacgtcaaaaacctgaaaagccacgaccagggtaaaacgttccgcatcatcatgcagacgctggacgaactgggctatgacgtggccgacgcagacgataacgggccggacgatccgaaaatcatcgatggcaaacattttctgccgcagcaccgtgaacgcatcgtgctggtgggttttcgtcgcgatctgaatctgaaagccgattttactctgcgtgatatcagcaaatgtttccctgcacagcgagtgacgctggcgcagctgctggacccgatggtcgaggcgaaatatatcctgacgccggtgctgtggaagtacctctatcgttatgcgaaaaaacatcaggcacgcggtaacggcttcggttatggaatggtttatccgaacaatccgcaaagcgtcacgcgtacgctgtctgctcgttattacaaagatggcgcggaaattttaatcgatcgcggttgggatatggccacgggtgagaaagactttgacgatccgctgaatcagcaacatcgtccacgtcggttaacgcctcgtgaatgtgcgcgcttaatgggttttgaagcgccgggagaagcgaaattccgcattccggtttcggacactcaggcctatcgccagttcggtaactcggtggtcgtaccggtctttgccgcggtggcaaaactgcttgagccaaaaatcaaacaggcggtggcgttgcgtcagcaagaggcacaacatggccgacgttcacgataaggccactcgcagcaaaaatatgcgcgcgattgccacgcgtgatacggcgattgagaagcgcctcgccagtctgttaaccgggctgggcctggcgtttcgcgttcaggacgccagtctgcccggacgcccggattttgtcgttgatgaatatcgctgcgtgatatttacccacggctgcttctggcaccatcatcactgctatttgtttaaagtgcctgcgactcgaaccgagttctggctggagaagataggtaaaaatgttgaacgcgatcgccgcgatatcagtcgcttgcaggaactcggctggcgcgtattgattgtctgggagtgtgcgttacgtgggcgcgagaagctgacggatgaagcgcttagcgagcgtctggaagagtggatctgcggcgaaggtgccagcgcgcagatcgacacgcaggggattcatttactcgcttgatgcgtcctgaataacgggcgcaactacgggttttgccgggaagagatattttcccaacgtgaccagtaacaccgcgaagacaatcacgccgagcgccagccattcaatcttcgacagcgtctctccgcccagtcccgtacccagcaagaccgcgaccaccgggttaacgtaggcgtagctggtggcgagagccggactgacgttgcggattaaatacatataagcgttaatggcgataatcgaaccaaacagcgccagatagccgaccgcaaggaagcctgaaagggaagggagcgccgtcagtttttcacccgcaatcatcgacgcgatcattaacaccacgcctgccgccagcatctcaatcgcacccgccatcatccctacaggtaaggtaatgcgcgagccataaaccgagccaaacgcccagctaatcgagccgattaaaatcagaatcgcgccccacggattgccgcttaaatttccaccgctattgagcatgatgattccggcaagcccaatggcgatacccacccattccagtttgcgcgttttaatgccaaacaggcggctgaagcacagggtaaagaggggcacggttgcaaccactacggcggcgatgccggaaggaacattttgatgctcggcaaccgtcaccatgccattaccgacagccaataataacaggccaatcagtgcggcattgagcagcggacgtagcgggggaagtttgtgtccgcgcagtagcaaaaatgccagcaataaaataccggctgccaggaatcgcacgcccgccatcattaacggcggccagctttccacgccaatccgaatgacaaaataggttgagccccaaatgatatacaacgcaaacaacgcgccaaaaagcggtaacaactggcggaaacgcataatccctcacggcggaaataaaaaggtggttcatagtaaacgtgaaaatcattctgctggcgagagatataattgcacttgattgttaaaaaaatgttgacctgtgaagcaagtatcagagctaccgtttttgcttcatacttacacccttcaacaataaaaatgagagggaatgcttttggccgggagtagtttactgacgttgctcgatgatatcgccacactgctggacgatatctccgtgatgggcaaactggcggcgaagaaaaccgccggtgtattaggggatgacttatcgctcaatgcgcaacaagtttcaggcgtgcgggccaaccgggaacttcccgtggtctggggcgtggcgaaaggatcgctgatcaataaagtgattctggtgccgctggcgctgatcatcagtgcgtttatcccgtgggcgattacgccactgttgatgattggcggcgcgtttctctgctttgaaggggtagagaaagtgctgcatatgctggaggcgcgtaaacataaagaagatccggcgcagagtcagcagcgtctggagaagctggcggcgcaggatccgctgaagtttgaaaaggacaaaataaaaggggcgattcgtaccgattttatattgtctgcggaaatcgtcgccatcacgctggggattgtggcagaagcgccgttgcttaatcaggtgctggtgctttcaggcatcgcgctggtagtgaccgtgggcgtctacggtctggtaggggttatcgttaagattgatgacctggggtattggctggcggaaaaatccagcgcgctgatgcaggcattaggtaaagggttattgatcattgcaccctggttgatgaaagcattatcgattgtcggcacgctggcgatgttcctcgtcggcggcgggattgtggtacatggtattgcgccgctgcatcacgccattgaacatttcgccgggcagcaaagtgcagtggtggcgatgatattaccgactgttttaaatctgattcttggatttatcatcggcggcatcgtggtgctgggagtgaaagcagtagcgaaaatgcgcggtcaggcacattaatactcgcactggctattatgcaaaattcgccatcttcaactaaggtgaacaagtttcactcgaaaaaaggaggcgagtatgagctttatggttagtgaggaagttacggttaaagagggcggcccgcggatgattgtcactggatactccagcggtatggttgagtgtcgttggtatgacggttacggggtcaagcgggaagcttttcatgaaaccgagcttgttccaggggaggggagtcgtcctgcggaagaagtttgacagggtatcattaagaccaggccggatcacatccggcctggtgtgccaatgcctgcaatgaatgatagtcgcgtcttatcatgccaccattataaaattatcgctgttttgcggtacgttatcgccgggttatgccagaatcataaaaaagcaggttgggagtcgtcagggtgcagcacgagacaaaaatggaaaaccagagctggttgaaaaaactcgcacgccgcctggggcctggtcatgtcgttaatctctgctttatcgtggtattgcttttttccaccttgctcacctggcgtgaagtggtggtgctggaagatgcctatatctccagccagcgtaatcatctggaaaacgtagccaacgcgctcgataagcatttgcagtataacgtcgacaaactgatctttttgcgtaatggcatgcgcgaagctctcgtagcgccactggatttcacctctctgcgtaatgccgtaaccgagttcgaacagcatcgtgacgagcacgcctggcaaatcgaactcaaccgacgacgcaccctgccagtcaatggcgtgtcggatgcattagtcagcgaggggaatctcctgtctcgcgaaaatgaaagcctcgacaatgaaattaccgctgcactggaagttggttacttgctgcgactggcgcacaactcctcgtcgatggttgaacaggcgatgtatgtctcgcgtgccggattttacgtttcgacgcagccgaccttgtttacgcgcaatgtaccaacgcgttattacggctatgtcacccaaccctggtttatcggccattcgcaacgagaaaatcgtcaccgcgcggtacgctggttcacatcgcaaccggaacacgccagcaatactgaaccgcaggttaccgtcagtgttccggtagacagtgataactactggtatggcgtgctggggatgagtattcccgtgcgtaccatgcagcaatttttaagaaatgccatcgataaaaacctcgatggtgagtatcagctctatgacagtaagctgagattattgacctcttccaatcctgaccatccaacagggaatatttttgatcctcgtgaactggccttgctggcgcaggcaatggaacatgacacacggggcggcattcgtatgaacagtcgttatgttagctgggaacgtctggaccatttcgacggtgtgctggtgcgcgtccatacgctaagcgaaggcgtgcgtggtgatttcggcagtatcagcattgcattaaccctgctgtgggcgctctttaccaccatgttactcatctcctggtatgtgattcgccggatggtcagcaacatgtatgttttgcaaagctcgttgcagtggcaggcgtggcacgacaccttaacgcgtttatataaccgtggcgcactgttcgaaaaagcccgtccgctcgctaaattgtgtcagacgcaccaacatcctttttctgtcattcaggtcgaccttgaccattttaaagcgattaatgaccgctttggtcatcaggcgggcgaccgtgttctttctcatgctgccggattaattagcagttccttgcgtgcgcaggacgttgccgggcgggtcggtggtgaggagttttgtgtgattctgccaggcgcgagtctgacgcaggctgcggaggttgcagaacgtattcgcctgaagctaaatgaaaaagagatgttgatcgccaagagtacgacgatacgcatcagtgcctcgctgggggtaagcagcagcgaggaaaccggtgattatgattttgaacaactccagtcactggccgaccgtcgactttatctcgctaaacaggccgggcgcaatcgggtattcgcgagcgataacgcttaatgggcggagaaaaaatggtccagcccttcacgccagccttccggtccttcacgctgcgttcgccagacgcgggctggatcctcatcatgcagatgcaccccttcacggtttaaccctttcacaatcaccgcgtaatccattacctccagtaagggtgcatcgtttggcccatcgcccaggccaagtgtggttgggcgtttgcctgacaattgttgataggtcgcgataatccagttggcagcctgatcttttccggcagaggcatccaggacgtgccagaagcgcgcaccctgcataaactgcaagcccagctcgtgcagacgagtggtaaattgtgccatacgctcgtcactgtcgcgccagattagcgttaccgacgcctcatgcagctgcgtcagcgccgcctggctacggcttaatcctgtccattcggcgatggttgcatcgtcgacatcatcaaaagttgtgaatttaaaatgttctttctcgcgtagcgtatttaaaacctggctgatttcgccatggctaatacctgagatgatgcgtggaaaaccgtctatatcctgccattgctcagcaagctggatcactgcgccattttcggcaatcagcggtaaaccttgtagccccaacattttttgcaagtacagcatttccgctgatgtcttactgctacagagaatgacgggaacattcgcttcgcgtaaacggctgagccagggggcagctggttgccagtcataactatgactgtccagcagggtgccatcaagatcgctaaaaaccagtagtggttgttgaattgaaagcatggttgcgcagtactccccttaccaggatgattcttaaaacagcacaaattatcaaagatgattttttcgggagcgatcccgttgacgccagagccaccaaggggtgacgcgcgtcacatttctattcataagtagcgttaatcattcatatcacgaatattttcttgtcagcgaaaaaaattgcggataaggtgatgaacacatcagatttcctggtgtaacgaattttttaagtgcttcttgcttaagcaagtttcatcccgaccccctcagggtcgggatttttttattttgcattcaacgattcacttcagagacgctgaagtcatgaatatccagttcgaaggcatccgccaattcacgccaagtatgatattcacgtccatcgacgctaacgtgttcagaatcgttctggctgcgatgaacttcgctttcgctaatttcattgatcgccgccagcagggcatcgacatcgacgctgacctcacgttttgcggtatcgctgtactcttttgcggttttcatcatctttcctcgcaaccgttgctctgttgttgccgccagtcgttaagtccgcctggcatctcttaagtatagaccgtcgagaaaatcagcactcgcgcgcgcctggcgctgccagaaaaacgaaattgttctacactggcacaaagccacaggaggaaaacgatgaaggtgaatgatcgggtaacagtcaaaacggatggcggtccgcgtcgtcctggcgtggtactggcagttgaggagtttagtgaaggcacaatgtacctggtttcgctggaagactacccgctcggcatctggttctttaatgaagcagggcatcaggacggtatctttgtggagaaagcagagtaatctaattcagcctgactggtgggaaaccaccagtcagaatgtgttagcgcatgttgacaaaaataccattagtcacattatccgtcagtcggacgacatggtagataacctgtttattatgcgttttgatcttacgtttaatattacctttatgcgatgaaacggtcttggctttgatattcatttggtcggagatttgaatggttccctgacctgccatccacattcgcaacatactcgattcggttcggctcaatgataacgtcggcatatttaaaaacgaggttatcgttgtctcttttttcagaatatcgcccaggatatcgtcgagagattccggtttaatcgatttagaactgatcaataaattttttctgaccaatagatattcatcaaaatgaacattggcaattgccataaaaacgataaataacgtattgggatgttgattaatgatgagcttgatacgctgactgttagaagcatcgtggatgaaacagtcctcattaataaacaccactgaagggcgctgtgaatcacaagctatggcaaggtcatcaacggtttcaatgtcgttgatttctctttttttaacccctctactcaacagatacccggttaaacctagtcgggtgtaactacataaatccataataatcgttgacatggcataccctcactcaatgcgtaacgataattccccttacctgaatatttcatcatgactaaacggaacaacatgggtcacctaatgcgccactctcgcgatttttcaggcggacttactatcccgtaaagtgttgtataatttgcctggaattgtcttaaagtaaagtaaatgttgcgatatgtgagtgagcttaaaacaaatatttcgctgcaggagtatcctggaagatgttcgtaggtattatttttcggataatccttaggataacatgataaacgttacggaattatattaatggcaattcactaataatatcagccagcaaattaaacatctcactgaataaatgttcgcaaaaaggcgcaattaacggcattaatgccgccattaaagagataccgacagtcagagttaatggaaatccaataacaaaaatggataattgcggggccatacgattaagtaagcctaatgccagattcagggtcagcagcagagtaatgagcggtaatgccagcatcagcccgttaaggaaaatcaaactccctgctttggtgagtgccagaaacgcattgctgttcagtggttcgccaccaattggcagggtgtgaaaggtatcgaccagcagtgaaatcaaccataaatgaccgttaaatgtcaggaacagcaataatgccagcatatccatgatacgcgctagaacgggcatattgagatggctggccggatcgacaaacgtcgcaaatgacagccccatttgcagaccgataatttcgccagcggttcgtacagcggcaaaggcaaattgcatggtaaaaccaagcgcaatgccgatcaggatctgctgcacggccagccacagagcaaagaacgaaaaaacaggaacatcgttggcaggtaatgatggggcaatagcgaacgtgatcatcattgccagacccagttttacccgtttcggcacgctgcgttcgctcagaattggtgcggtagaaatgagcgccagcacgcgcagtaacggccagaagtacaggcttaaccaggaaagccattgatcgcttgtcacctgcatcattgtacggcctacccgatgatatacggcaggttagtgaacaaggtgcggacgtaatccagcaacagattgagcatccacggtccggcaataataatggcgataaatacggcgatgattttcggaataaacgacagcgtcatttcgttaatctgcgtggcggcctgcaaaatactgatgataaggcccgtgaccagcgccaccagcaacagcggggcagccagtgccagcgcgactttcatcgcttcagtccccatcatcatgaccgattcaggtgtcattttgcctctctagctgtaaaagctctgcgccagcgaaccgaccagcaattgccagccatccaccagtacaaacagcatcagtttaaagggcagagcaatggtggctgggggaaccatcatcatccccaatgccatcaacacgctggcaatcaccaggtcgataatcaaaaaaggaatgaaaatcgtgaagcctatctgaaatgcggttttcaactcgctggtcacgtaagccgggagcaaaatgcgcatcggcacggcttcaggtccctgcaacgggccggtattcgccagtctggcaaacaaccctaaatctgcctcacgggtctgacgcagcataaactcacgcagcggctgcgcccctttttccagcgcctcctgcattgatattttctcttcgctaaatggctggtacgcatcgacataaattttgtcgatcaccggcgacataataaaaaaggtcaaaaacagtgccagccccagcaatacctggttaggtggcgcggagggcgttccaagcgcgttacgcaataaaccaaaaacaatgatgatgcgggtgaaactggtcatcatgagtaaaattgccggaataaacgtcaacgaggtgatgaataccagcgtctgcaccgggagcgaccagctttgtccaccgccaggcagcggctggctggtgatacccggcagttgcgcgaaggcgaggggcgtaaccagccagagaaggacaggtgcgacagacaacaaacgacgcatcaggatctcccgctacgtttaagcaagtttttcatgaccgactgaaaatcggtctgcggtatctcttccgttggtgctgaagggggaagtttatgcagcagattgatttgcccagcggtaacgccgagcaccagccgtgcatcttccacatcgactaccacgacccgttcacgcgcgcccagcgaagcactggcgctaattttcagaccgttaacgccagtgcgtttcggggcaaatcccagccgttttaccagccaggcagcagcgaggatcagggcaataatggcgatgagtgcgccgctcacctgcagcagtggcgcagcagaaaccggcgcggaagattgcacagtagcgtggttattcatcactaacggctcaggcggcgcatccgctcagacggagtaatgatatcggtgatccgcacgccatatttatcagcgactacgacaacttcgccctgagcaattaaataaccgttgatcagaatatccagcggttcgcccgccagaccgtccagcgccacgactgatccttgcgtcagacgcaataactctttgatggtcattcgtgtgcggcccagctcgacggtcagcttgaccggaatatccataatcaggtcgatatcctgcaacgttccgctgacatcaccaccgccaaattgctggaacaccgcgtcggcagcgcttttgccgctggttgatttttgttcgctcaacgcttcagcccacagatcgtccattgcgccgttgttgtcatcggccggattattcatgtcactcatttgggctgttcctcgttcagagaatttaaaatcgggttaatcaaatgttctatccgtaacgcatactggccgttgagagtgccgtactgactggtcagcaccgggacgccgtcaacatgggcgatgatgcgatcgggtttttctatcggcaggacgtcgccgggtttcagttttaaaatctgcgacaggcgtagcgagatatcggcaaagttggcgaccagctccagctgcgaatgctgcacctggcgcaccaggttatcgcgccagttctgatcttcattacgcgagttttccagcggcgggttaaccaacaattcccgtagcggctcgatcatgctgaatggcaggcagatattaaattcgcctgtcaggttgccaatctccacatggaacggcgtgttaaccacgatgtcgttcggcgaggtggtgatattggtaaatttcacctgcatttccgaacgcacgtactcaacttccagcggattaatcgccttccaggcgtcgctatagccttcaagcgccagctttaacatgcggttgatgacacgctgttcggtatgggtaaactcgcgaccttccactttggtcgggaagcgtccatcgccgccaaacaggttatccacggcgataaacaccagactcggtgagaacaccaccagccctgtgccgcgcagcggtttcagatggataaggttcaggttggtcggcaccggcaggttgcgggcaaattcatggtacggctgaatgcggatggccccgacggtaatgtccgggctacggcgcagcaggttgaacagccccatacgaaaatggcgggcaaagcgctcattaatgatttccagcgcctgcaaacgttcgcgcacaacccgtcgttgggtattcggatcgtacggacgaatgtcactttcgccgctaacactggctgtcggttcgtctttgacttcgctgtcaccattcaacagcgcatcaatttcagcttgagaaagaatactatcgcccatgtcgttatcgcagaataaaagcggtatacagcacgtcggtgacatcctgtttcggttgcccggcaacaagcggggtggaaagtgtggttttaatctcggcaatcaggtttttcttgccttcttctgtcgccagtacggcagcatcctgacgcgaaaacagtaacagcaagcgactacggacttccggcaaatactcactcagccgcgagcgggtagcttcatctttcaggcgcagggttatgccgatataaagcacgcgatccgcatcgcccagattgaccgtaaaggtatccagcgcatagaagaccggggagggcacgacgcgttgctgcgctttgtcttcagcggcaacctgatgcgaatgccagtagctgtaacctgcgctggcacaggccgcgagggtaatgaataccagaatcgggatccaaagcgatcgcttgcttttcttgcttatcgcgtaatcagtcatgtgttgcggtcttcctgtgtcgctactgcttatcggctaattatcctgcgtcttgagcgcaacaaagcggggaaaagacgcggattacggtgctacctctgacgttaggcgaaaatatcaacgccgctgttgcctgttacacgcccttgtaaagagacgggaaccggaagcgtatcgtcgtcttcccccgccagaggttcatggtttgctgtgcgttggctttgctgttgctgggaagcggcctgctgctgaccactaaagctttcgccactgatgttgctttgccctaactgaatgccactttcggccagctgcgtacgcagtaccggcagcgctgcttccagggcggcgcgtacgtgctgatgcggcgaaaccatctggatttgcgcctggttatcatccactttgagggagatttgcacttcacctaaatcctgtgggtgcagacgcaactctgcactttgttgcccctggcgggtgaacagcgaaatatgctggcttaatgattgttgccattcgtgagaacccagcggtgcactcaaaacaggcgcggcgacggtgggtagtggctgtgtctggtgtggagtgattagcgggctggcggcagcggtcaccggcgaaggcgtgctgatgatttccgctttactctgggcttctgctaccagcggtgttaatggctgagctggtgtgccgggggcatcatcaggctgtgctgttgtgagttgcgcagaagtcagttttgtgaagagcgttggtttctctgccggtaacacggttgacggcacatcagtcactttgggcgtattgtcaaaacccggcaacatcgcaaaaagggcgctcaggcttgcggtgacgtcttcattcagatcatccgctttttcgtcttttgtcgtatttttgtcagccgccgcagccaacgtcatcgtctgagcggtggttaacggtgttgatgtggattgttcgtcgttgatgacaggcagtgtttcatccacggggatcagtaaatccgcttggtgcgcgtcggaaacaatatcgctgaccagcggctcgccttttgtcgtgggcttatctgttgccaccagcagctggggggccgctttgtcggtagttgcctcgcctgctaatgcttcgcttaacaacgcgagaaaatcttgtgcagcatcgctggctttgccgccaggcaatgtggtggtgtcaacgtcggcggtaatcaagggcgctaagcgaatcattcaggtttcctcatggcggcgcgctgggcgaactcatccatctttttctgatcgaggcggttttctgcaagcagtgccgccgtggattgccgttcctgcagtgtctgccaggcctgcaaacgttgtttcttttctcgccagctgttcagggcaatgtcaactttctgcgtccactgattaagttgctggcgatgctgagtaatggctttttccagcgtctggataaactgctgatagttgatccagcggttgctggtcatcccggcactcatatcgctattgaggttattgcgatattcattctgataatcgatcagcattttgagctgttcttccgcatgctgacatccgcgacgcatttcacccagcaggcgcgcggcatcctctacctctttttctgccagatctttcagggtcgccagcgcgccatgttctgccatctgccgttatctcctgggttatgacactgtcgggaaaatacgctccagcccctggagagacgcttcccagtccgcgcgttcaaaaatgccttgttgcaaatagccctccagctgcggccacagggcgatggctttatcgagcatcggatcgctgcctttggcatacgcaccgacgctaaccagatcgcggttacgctgaaaactcgacaacagctgtttgaaggtgcgtactcgcgcataatgttgctcgctgatcaacgccgtcattgcgcggctgatcgacgcttcaatatcgatagccggatagtgcccggcttccgccagtcggcgagacagcacaatgtgaccgtcgaggattgcccgcgcggagtcggcaatggggtcctgctggtcatcgccctcggtgagcacggtataaaacgcggtaatcgatccgccgccgctaatgccatttccggcacgctcgaccagtgccggtaatttggcaaacaccgacggtggatagcctttagtggcaggtggttcgccaatcgccagcgcaatctcacgctgggccatcgcgtagcgggtgagggagtccataatcagcaacacatgctgaccacgatcgcgaaaatcttcggcaatgcgtgtggcataggcggcaccctgcattcgcaggagcggagaaacatccgccggagcggcaatcaccacggagcgtgcacgcccttcggcaccgaggatattctcaataaaatcttttacttcgcgcccacgttcaccaatcaaacccacgacaatgacatcggcgcgggtgtaacgtgccatcatccccagcagcacacttttaccaacgcccgacccggcaaacagccccatacgctgcccgcgcccgacggtaagcagggcattgattgggcgcacgccggtgtccagcacatgttcaatcggtgtacgttgcaacgggttaaatggcggggtaatcagcgcaccggtttccgtcgtatcggggaagggcaggccatcgagcggtttaccgctgccatccagaacgcgacctaataacgccggaccgagcggcaactgcttgccgctttgcagtccttcagtcgaaatgtttttggcataaacacgcgcgccgggcaggacaccttccacttcctccagcggcattaaaaacagccgttgaccgttaaagccaacgacttcgctttctacttcgtgggtttcgctgccgttctggcgttcaatgacacaggttgcgccgagcggcaattgtaatccggtggcttccagcaccagcccggtagcgcgagttaatcgcccgtagcgacgtaccgcaggcaactgcgccattttggcttcaaagttatccagcgtggttagccagcgagtcaggcgcgtggtcattacaccactcctggtgctgccagacggcagagttcttgccagcgagtggcgacactggcgtcgagatcgccttcatcggcggagactttacagccgccaggatggagggtgggatcgccccgcaagcgccagccatgcaaacttaaggttgcgccgagcatatcatccacacgttgcagatcatccgggtgcacgcgcagctgtggtttaccgctgaataacggttcttgctgcaacaactgttggatctgtttgatcagtgccgagttgtccaccgttggcgtctgaccgatcacctgacgtgccgcctccagcgccatctgcatcaggcgcgaagcaatcacactatcaagcgcatcaagggtagtttgaaattcgctgaccagttgctgcatccgggcatgaattggcgcttgttgagacttcgcctctgccagaccttgttccagcccctgggccagtccttcctgatagccctgctcatgaccttgctggcgaccttcggcaatccccgcctgataaccttgctcgtgggcctgcatttgcagttgcgccagttgctgctcaaggctgggttcggcctcttcaatgatggtttcttccggctcgaccatgggcacaaactctgcctgtggtggcgcgagatcgtccggcgtccaggttttccacggcagattatcagacataggtatcctcgccgctgccaattaccatctcgccagtttcggcaaggcggcgcacaatcagcagaatcgctttctgttcgttttccacctgcgacagacgcaccggaccacggttggcgagatcgtcgcgcagaatatcggcggcacgctgcgacatattgcgcaggaatttctcgcgcagtggttgctcggcccctttcagcgcgatcaacagcgattcggaatccacttcctgcaacagtcgctgaatgctgcgatcgtcgacatccaccagattctcgaacaggaacatctcgtcgatgattttctgcgccagctcgccgtcgaattcacgcacggcggtaataacggcttcttcctgctgagttttcatcaggttgataatttcggctgctgttctcacgccgcccattttactgcgcttgagattctgaccgtcgagcaagccattcagtacttcggtcagttccgccagcgcggctggctgcacgccaccaaaagtggcgatacgcaacatcacgtcgtggcgcagacgttcatcgaacaacgccagaatatcggcggcctgggcgcgcttcagatgcaccagaatggtggcgataatttgaggatgctcatcgcgaatcagatcggcggcgctctgcggctccataaagttgagcgtttcaataccgctggcggtatcgcgggtttcgagaatatcctccagcaggctggcggcacgttcttcacccagagctttgaccaataccgaacgcagataatcgttggcgttgatattcagtgcggcaaactgttcagcttcttgctcaaactccgccagcacatcggttagctgcttgttggagatctgcgtgacgttcgccattgcagcgctcagagtttgcacttcgcgctgggaaaggtgtttgaacacctctgccgcccggtcttcgccaatggtcatcagcaggatgacgcttttatcggtgcctgtcaggttactcatgatcgttatttatccactggcgaatgaccagcgccaccacgcgcggatcgttatcagacatttcacggatacgctggctcatgacttctgcccccagtcgttggttagcgcgccgttgttggagttgttcgtctttgctcaggcggacttccaccgcatcttccacttcctcacgggcctgcgcctgttgctgcacagctttcatcgcctcagcgcgacgtgttagctgcgggcgtaccgctttccgccacagcagccacgccaccagcagtaccagcaaccagcgaccggcagccattaactgatcgataaacgcttgctgttgccagaacggcagttctccaccgctttcatcactactattgaacggcgagttaacaacattgagcgaatcaccgcgtttttcagaaaagcccatcgcctcgcgggtcagatcttcaatttgcttcatctgttcgttgctgagaggcaacggtttgccatctggcaaggttttgtaattcaccacgaccgcgacggacagacgttgcacatcgcccacgttcattttggtatgacgaatggtgcgatcgacttcgtagttactggtttcattccgctgtgtgctacgcggcccactattgctggtggtgctcgcctgctgctggcggttattttgatttgccggaggcgtgctgattggcgcgttattcgcaggagccggttgattcgacaacgcccccggtacgccgcccggataaccggaaccgctttgctcgctctcattaagctggcgtgaacgaagcgccgcatgagattcatcaccgttagggcgatactgttcttccgtttgttctttactggcgaagtccagttgcgccgtgacctgggcgtgaatattaccgttaccaacaattggcgacaggatcgcttcaatacgccgctgaatccggccttcgacatcgctggcatatttcaactgagcgtcattaagatcgcgcccgctggtattggactgggttaacagatgtccaccctgatccaccagcgtgacgttccctggcggcagaccagcaaccgcactggaaaccagatgcacaatggcgctaatttgcccttcatcgagtgcgcggccgggtaacagatttaccgtcaccgatgcagaaggggatttttgttcacggacgaataaagacggtttcggcattgccagatgtacgcgcgccccttttaccgggccgatagtttcgatggtacgagaaagctcgccttccagcgcccgctgataattcacctgttcgctgaactggctgataccaaacttttcctgatcgagcagttcgaaaccgaccgcgccgcctttgggcaaaccttgttgcgccaggcgcagacgcagctcgtgaactttatctgccggaacttcaatagcgccgctggcttcgctgaagcggtaaggaatattcatttgcgtcagttggctgacaattgcgccaccatcctgatcggaaagattgctgaataatgtgcggtagtcgggggctttcgcccacaggatcagtgcgaccatgaccgccactgctgcggaaccggcaacaatcaatggaattttcggattcgcacgcaggcgattaagccactcaagagattttgtctgggctgcagtcgcattcatcgcgcacctcgtggctgattatggacggcgttattggcaaagtggaacaagactcactcccgggtcagcaaactcgaaaaattgacgctcccattatttgtgctttcgtttttttctatccgccaataaacccgtttttttgttgctatttagcgcctttgtcttattgacttactggtaggctttgctaccagaaattatgcgggagatgaaaatgtcagcgatacaggggattgaaggggttatcagccagttacagaccacggcgatgagtgcgcgtgcgcaggaatcactgccgcaaccgaccattagttttgccgggcagctgcacgccgcgctcgatcgcataagcgatacacaaacagccgcccgcacgcaggcagaaaaattcactctcggtgaacccggcgtggcgttaaacgatgtgatgaccgatatgcaaaaagcctcagtttcaatgcaaatggggattcaggtgcgtaataagctggtggcggcgtatcaggaagtgatgagcatgcaggtgtaggttgtgtaacctgttgactatgcttgtttaattacatccgatctcaccgcgtggggcatggatggggcaaacacactcaatttctggtttaaaatggaaacctgattctgaacgttttctgccatccacgatccgtaaacgcaataaaccctttgaccatcagagtgtctcatttgacacatcaccacgtcggatgttgttacgaccacagacgcaacagtaacctctggataatttaatcttcgttcttatttttattaatatactgcgttataaaaatgagcgatttttgatagtggtaattttattatgttttagaatgctccctgggcaatataatttattaaacaggagtgtaaatgtttccattaaatgatctttcgttaaaaactcagccggttcaattaaataaagtcacatctaatactgaatctacgataaaacaacacgagttagtatctgatgatgcaatcataaatgaattatcaagtgagttagtcagttgtcttggaaatggtaagtttacaccaattagtgaagacagcaaattatttaatatgctgtcagaatttaagttattgcactcagaatatttcgaatggggtgattatagtctctggtttcaaggtttctcgatttatgataagacaggttttatcatgatagaaaaaagtcagggagctggtaatccacccattcggcatacattagagtttatatcgactaatattgcagagtttctagacaagttaacgaaaattacagatgccagactttgcaaaggtttcagtgactgggctaattcagtcaaagaaggcgcatcgaatgacttcaaagaaaatgtggatatagcattggtgagattgtttaaatgtgttgaactccacaatagtaaacttgacttaacagatcttcacttggggtctttgccacctcttccagactggattgaggtgctttctcttcgtcataatggccttgccacaatacaaattcccaaattctgcaaagaattagaactcgattttaataattatatggtatttccaaaagtatccgatggaattacccaggtctccgtagataataatctgatatcgcgtgttgactcatctccgtcaaaggctatgaaaatttttatttatcgcaataaaatatggtaaataccagcaatgcctgagactactaatctgtttaattgtggtgataataagataaaaaaattcaatacttcccaaatcatctggagacagcacgtatggagtataatattgaggttgtccctgcgatacatagcaatttaaaattactttttatagaatgttatcctattaaagaggagtttttaatgccgtggactttgacagacattacctatgaaatatcgcagcgaaaatatattgttacgaattccgctgattatgataaatattctgacatagtcaaaaggggcgtaatagatggtaagaattaaatagttaggcgcaattgtgtcactggaatagaggtttcttgtggcgcatgtggaaggagcgtctaaggacaagacatatgcggctggtgatgaataaaggcgcagcacgtcgaatgcaagaatgtgctgcgtctggctcatggcaattcattattttcgcatagcgtcaatgacaaaaatcgactgtgtggatcaagttgataatcagcaaacggttcgcaatcaacgaaaaccatgcttcaaataaagttgatggcaggccgtaaatccagcctgtgtacccgtttctaagctcaggcgatgaaggcatctgtcatgggcgacctgcaaaatgtggcgtaaaatcagactggcgacacctcgacgtaaataatttggcgcggtacgcattgatttcagttcgccatgtttatcatccagcaacttcagcgcaccaattcctgcgagttgttcgccttcccatactgaccagaatgtcactgtcgggttacgtaatttttgcacatctaaagcatgactgctttcggggggagactgctgcagcatgccggaaatatggtaagccactaatgcttgcactgctggatgggtgagatcatctgttttaatcgtgaacatgacgattccgtattggtgttatttttgcaatatgccaacaggtactgaaatctttgtctaatagagatttcttatgacgcagtattgttgatcaataatctccaggcttatcagataggttgaattaactccgcgccctggtttttaacattacccaccgcgcgcgataccgggtgccaggtgaactggtttgctggcacacagccactggtagcgatttcagaggcttctttaccgccaatctcttgccgcatccatttccgcgcagcttctggcgacagtaccagcgggcggcggtcatgaatatctaccagaccttggtctgctgctgcagtgacgatcaaaaatccttcggcttcgtcaccacgctcgaacggtgtgctgcctatcgcggccagaaaaacaggttgtccatcagcacgatagataaaataaggctgctttttgtcgccttcttttttccactcaaaccagccatcggcaaaacagattgcccgaccgtgttgccagagcggtttaaacatgcgactggttgcggcagtttctacgcgggcgttaatcagcggcggtttatcccaccatccgggagcatatccccagaaaaccggatccagatgaaggtgttcatcacgttcactgagcagaagaactttggttcccggcgcgacgttgtatctgccaatgggttcgggatcgtagggaatatcgcgttcaatatcttccgcgagaagcgcaaggtaatcttcacgcgtttgggattgggcaaagcgtccacacatagcaacctcctgagatcatactgaaaagaataggagagggggcgggtaaaatctatgtgtcagaggtaacgatgttcccgctgttggccacagcgggaatgagggattacttctgaattaaataacgaatggtcggcccgtcttgctgaatatccagcaccgtatagccgtgattacgcgcatccagtggaatattattgatcgactgcggacagtcgctcaccacttccaggatctcacctttttttaattgcggcatcgcctcaagggttgcgactgccggataagggcagggttcacccaccatatcaaggcggtaatcaggaacgatatttttcatgcgatctccttagcagtctgcggtgccgcacggcggaagaagcgtttttcccagccgataatcaacatcagcgcagcaaacaacagcaaatatgtcaccagcaggccacccatcggaccaaaggtttttagcaggttgattttgtcccagtcggtggccagcgccggagcgaaatcatcccagtaatacgccagaatcgttgagccgatcacattgcccagaccgacccaccagtagtgcacctggccttctaccgcgcggtacatccagccggtttcgcagccgcctgccagcacgatgccaaaaccaaacagtaaaccaccaattaccgcgtttggtcccgcccacatgattttaggttcaacgcctaactgtatgtaactgaagatcccgatggcacttaccgccataccgataatgattgctttcgccatatgggtacgtccggtgatccacatatcgcggaacgccgaagtaaagcagatttgcgcacgttcaatcagtaaaccaaagccgacgccaaacagcattgccagccccagttttggttggttcatcgccgtgagcagcgcccagcccagcatgccgaaaaagaccagcatcccgagacgaaaacgacgccgcgcctgatccggtttttgcgtcagcggtgaggcggcagaaactttctgcattttcacgggaatacggaagatgggcagcagggtaaagcgcgcgccaaaccatgaaccaatggcagtggcgatggcaaagaaccaggcatgcagcgagaactgaggaatgccggtaaagaacgccgccaggttacagcccattgccagacgcgcgccaaaaccggcgataatgccgccaatgatggcctgcataatgcggatacggctgcgcggcatgcgtagtttgacattgttggcccacagcgctgcggcaaagcagccgccaaacataccgaggatcatcatcccgtcgatgcgggttaatggcgatccttccagatggataattttaaaataaccccactcttcagcatggacgccgaacagctgcaggagctgaccgccccaacgggtaaattcacccgtgacagcccaaaaggtgccagtgatgccaaaatagtaagtggagagaatacccgccgcgatgaccgcagggatgggtgcccagaatttaatcaaccaggcgtgtttgaattgctgccatgacatgaatgtagcctctgaactcagaaggtttgaaacaggagtcgcgaatcatacaccatgcaaatttattttcggggtaataattcacaaaaataatagttagatcaaatttctctctgaacctggaaaggctggcgacatcagggctttaatgccacaatcctcttttcttctcatgcaggacgaatgatgaaaaaactcgcaattgcaggcgcgctcatgttgctggcgggctgtgccgaagtcgaaaactataacaatgtcgtgaaaacccccgcgccggactggctggcgggctactggcagaccaaagggccgcaacgtgcgctggtcagtccggaagcgataggcagcctgattgtcactaaagagggcgatactctggattgccgtcagtggcagcgggtgattgctgtgccgggtaagttgacattgatgtctgatgatctcactaacgttaccgtaaaacgtgagctgtacgaggttgagcgtgacggtaacaccattgagtacgatggtatgacgatggagcgtgtggatcgcccgacggcagagtgtgccgccgcgctggataaagcgccgttaccgacgccactgccgtaatgaaatctccccggcttgccgccggggatgaatttaaatcacctcttcgataacccacacgctgacgctgccgccgttgcaaaagaaggttgcttcgccgttttcgtcggtcactacgctctcttgccggttccccagaaaatcacgccaggttttattgccgtaattctctcccagatgaatggttttttcgccatcatccccgttcgacatgaccaccacgcaaccgggatattcgtcagtgccactgcggctaaaggcaatgcagttcggatggtcgaaaaataacgtctgtacaccgtgggcgaaacgctgacgggcgagaattaactcatcaagctgttcgattattggcatatctatcggataggtttgcccgtcaccgccaacatcttcgtaatgcgcgccatagaggtcaggatagaacaccgaaggaacgccattttcccgcaacaaaattagagcatacgccagcggtttaaaccacggttcgacgggggcttcgagggcttgcaacggttgggtgtcgtggttggcaacgagggttacggcgtgaaaaggatcggcttccactaatgtacccgtgaaaatctgcgtcatgtcgtagtcgcgccccatgcgcgatgcttcatggaatttcatctgcagcggtgcatcgaacagcatggttttgccttccacctgatcaatatacgtttgcagtttatcgacttcatgcgaccagtactctgccacaataaacagcggctttggcgcaacttcctgtacgtgttcgatccactctttataaaaccacgccggaatatgtttgaccgcatcaagacgaaaaccgtcgcactgcgtttgttccatcacccagcgcgcccagtatttaatctcttccgtcacggcatgattgcggaaatcgatattctcacccatcagataatcgaaattaccgagttcatcatcaacctgatcgttccagccttcgccggtgtagtcgttaacaattttaaatatgccatcttcatcaggattttcgatatggtcgataccgctaaaacatttgaaatcccagataaactgcgagtattgcccggcacgggcggggaaggtgtaacgcgtccagccttcgcactcaatgatttcttcatcaatttgcgtacggtcatcagcatttacacgttgcacgcgaatagcttctttttcatccgcgcccattttgtggttgactaccacgtccaacagcaccgcaatgtcattacgtttcagggcgtcaatggcggccagcagttgtgctttatcgccatatttagtagggatgctgcctttctgatcaaactcgcctaaatcaaataaatcataggagtcgtagccgaccgaatacccgcccgatgcgcctttataggcgggcggcaaccagaccatattgataccaatatcattaaaaccgtcggcgcgctcggccagttcaggccagagcttaccgccttccgggtaataccagtgaaaacattgtaacagcgtgggattacgcattcttcgactccattcaaggggaacattagaagcgtagccgtaatcggattattcgcgagccatcggctcattaagattcaaaagaggttatcctgcggagccagcacaaagccgccctgatcgccataggcacttaacaccgatttttgcaccgatgactgaccgaccagtttcgccagttcatccatccgaatctgtaataactgctttaccttgctttcgttgtcgagaatcaggtgcagcatcgggcggagttgctcctgcatcgtggtggacggctcaacctcttcagtcaggtgtgcaatctcctgcaccgcattcacatacgccatttcgctggcgatgagttcgtcccattgttcttccgttgccaggcgtaacatgagctggcttttttcgacgagttgttgccaggcgaaatacaaatgcggtgcattgttcatcagactgggtcctgaatcaaagaaggggagagtaaagactctttccaggcatcggcaatattgcgcattaatgcttccacttcttcgactgcggagacatcgttgcgtaaattggcttgcagcaagcgcctgaccatatagctataaagagcaatcaagttttgggttagttcgtctttgctctcttcatcaagactcacccgcagcccgttctcaatgatgttgatcgcttttgacaaagagacgcctttgccttgctgattgttgtcctgcataaacaggcgcgctctaaccagtgcgctcagcactccatcaaatagcatggtgaccagctgctgttggctggcgctcattacggcgctttcgacgccaatttgtgcataggcctgggtgccttttgccgcgtacatgacctgtctcccgatgaatattgattacttggaattactgttgttttcgaactgctgcgttaagtagctgctggtgctgtttaacgaggtcattaaaacgtccagttgggtaaattgttctttgtagcgagcgacctgtgcatcaatgcgatcgctggcggcgttgtagtctttagttaacttattcagggtcttactaacgccatcggtagcggctttaataatgcctgttgtcgaaagccaactggtcaggttgctgccgatggtggtcgtgatgccggtttttttaccatcgccaacaatcaatgcacctacgccgctggcatcttttttcagtgcagcggtgagtttgtcggcatccagttccagtttgccatcgctgggatcggtcgtgataccaatctgcgccagcgttttatagttggaagaactgacggtattactcagcatcgatttcaactgcgtctgaatcgtccgcagcgtggagtcgccgagcagtgcgccattgctagaactctggctatcagctcccgcatctacggcggtgtatttggtcaggctgctgaaggtatctattagcgagttataggcattcacccagtctttaatcgccgtttgcgctttggaggtgtcctgagtgatggttagcgtctggttgcccgtggtgacatcattcaggttcagggtgatgttttccagcgcgtcgctgatggtgttgctgctgttctcaatggcgacgttgttgaccgtcagctgcgcattctgggcggcgaccgagacctccataccgttgctactggcactggcgtcatagcccataaaactttgtagcgcatcatcaccgctgaccgagagtgtcatcgcattatcaaggccggtgtcatttgatgtgactgacagacgatattcaccgttacccacgttaatgatgctcgcacttacgcccgcttttgcgttgttgatggcatcacggatcccgcttaacgacgagttagccgcgctgatatcaatggtaatcggatctttgtcgccgccttgttgaatggtgattttactgtcgctggtggcgatcaccgttttcgtatcatctctggtggtgcgcgtggtcagggtttgcgcctgcgccagatgggtgacgctgatggtgtatttcccggcgatggcgttacccgcggtggtggcactgaacgcggtggtgctgctggtggtgctggtggcggaaaaaagttcggctttagacaatgcagtattggcggtctggaaagtcgtcagcgcgcttttcagcgtaccgtaggcgctaagtttagcggtaaacgacgattgctgatttgaaataggggttagcgtcgctttttgcgcggcggtgaggctatcaaggattgaacttaaatccaggcctgacccgactcccagcgatgaaatacttgccatgcgatttccttttatctttcgacacgtaaaacgaataccggggttatcggcctgaattgcgcaaagtttacgtttaattgttttttttaatagcgggaataaggggcagagaaaagagtatttcggcgactaacaaaaaatggctgtttgtgaaaaaaattctaaaggttgttttacgacagacgataacagggttgacggcgattgagccgacgggtggaaacccaatacgtaatcaacgacttgcaatataggataacgaatcatggcacaagtcattaataccaacagcctctcgctgatcactcaaaataatatcaacaagaaccagtctgcgctgtcgagttctatcgagcgtctgtcttctggcttgcgtattaacagcgcgaaggatgacgccgcaggtcaggcgattgctaaccgttttacttctaatattaaaggcctgactcaggctgcacgtaacgccaatgacggtatttctgttgcacagaccactgaaggcgcgctgtccgaaatcaacaacaacttacagcgtattcgtgaactgacggttcaggccactacagggactaactccgattctgacctggactccatccaggacgaaatcaaatctcgtctggacgaaattgaccgcgtatccggtcagacccagttcaacggcgtgaacgtgctgtccaaagatggttcaatgaaaattcaggtcggcgcaaatgatggtgaaaccatcacgattgatctgaagaaaattgactctgatacgctgaatctggctggttttaacgtgaatggcgaaggtgaaacagccaatactgctgcaacacttaaagatatggttggtttaaaactcgataatacgggggtcactacagctggagttaatagatatattgctgacaaagccgtcgcaagtagcacggatattttgaatgcggtagctggtgttgatggcagtaaagtttccacggaggcagatgttggttttggtgcagctgcccctggtacgccagtggaatatacttatcataaagatactaacacatatacggcttctgcttcagttgatgcgactcaactggcggcattcctgaatcctgaagcgggtggtaccactgctgcaacagtaagtattggcaacggtacaacagctcaagagcaaaaagtcattattgctaaagatggttctttaactgctgctgatgacggtgccgctctctatcttgatgatactggtaacttaagtaaaactaacgcaggcactgatactcaagctaaactgtctgacttaatggcaaacaatgctaatgccaaaacagtcattacaacagataaaggtacatttactgctaatacgacaaagtttgatggggtagatatttctgttgatgcttcaacgtttgctaacgccgttaaaaatgagacttacactgcaactgttggtgtaactttacctgcgacatatacagtcaataatggcactgctgcatcagcgtatttagtcgatggaaaagtgagcaaaactcctgccgagtattttgctcaagctgatggcactattactagtggtgaaaatgcggctaccagtaaagctatctatgtaagtgccaatggtaacttaacgactaatacaactagtgaatctgaagctactaccaacccgctggcagcattggatgacgctatcgcgtctatcgacaaattccgttcttccctgggtgctatccagaaccgtctggattccgcagtcaccaacctgaacaacaccactaccaacctgtctgaagcgcagtcccgtattcaggacgccgactatgcgaccgaagtgtccaacatgtcgaaagcgcagatcattcagcaggccggtaactccgtgctggcaaaagccaaccaggtaccgcagcaggttctgtctctgctgcagggttaatcgtcctaacctgattaactgagactgacggcaacgccaaattgcctgatgcgctgcgcttatcaggcctacaaggtgaattgcaatttattgaatttgctaatttttgtaggccggaaaagacgtttacgccgcatccggcaacatgaagcgtaatttgtcagcaacgtacttccccgccaccggcggggttttttctgtccgcaatttactggtaacccccaaataacccctcatttcacccactaatcgtccgattaaaaaccctgcagaaacggataatcatgccgataactcatataacgcagggctgtttatcgtgaattcactctataccgctgaaggtgtaatggataaacactcgctgtggcagcgttatgtcccgctggtgcgtcacgaagcattgcgcctgcaggttcgactgcccgcgagcgtggaacttgacgatctgctacaggcgggcggcattgggttacttaatgccgtcgaacgctatgacgccctacaaggaacggcatttacaacttacgcagtgcagcgtatccgtggcgctatgctggatgaacttcgcagccgtgactgggtgccgcgcagcgtgcgacgcaacgcgcgtgaagtggcacaggcaatagggcaactggagcaggaacttggccgtaacgccacggaaactgaggtagcggaacgtttagggatcgatattgccgattatcgccaaatgttgctcgacaccaataacagccagctcttctcctacgatgagtggcgcgaagagcacggcgatagcattgaactggttactgatgatcatcagcgagaaaacccgctacaacagctgctggacagtaatctgcgccagcgggtgatggaagctatcgaaacgttgccggagcgcgaaaaactggtattaaccctctattaccaggaagagctgaatctcaaagagattggcgcggtgctggaggtcggggaatcgcgggtcagtcagttacacagccaggccattaaacggttacgcactaaactgggtaagttataacgtcagtaaatgccgcactttaattttgactaccaggagttcttaatgatggtgcagcacctgaaaagacggccattaagccgctatcttaaagactttaaacacagccagacccattgcgcgcattgccgtaaattactcgatcgcattaccctcgttcgcgacggcaaaatagtgaataaaatcgagatttcccgcctggacatgctgcttgatgaaaatggctggcaagtggaacaaaaatcatgggcggcattgtgccgattttgcggtgatttacattgcaaaacgcagagtgattttttcgatattatcggctttaagcaatttctttttgagcaaactgaaatgagcccaggtacggtgcgtgaatatgtcgttcgtctgcgccgtttgggtaatcatctacacgagcaaaatatttccctcgatcagctgcaggacggtttccttgatgaaatcctcgccccgtggctgcccaccaccagcaccaacaattaccgcattgcgttacggaagtatcaacactatcagcgtcaaacgtgtaccggacttgtgcagaaatcctccagcctgcctgcttctgatatatattaaataagaataagatgtagcggagttgtttttgtgtttacaaacaatggctctacactgcaaacagacataacaacattcggggtgaatatgaaattagcacatctgggacgtcaggcattgatgggtgtgatggccgtggcgctggttgcgggcatgagcgttaaaagttttgcagatgaaggtctgcttaataaagtcaaagagcgcggcacgctgctggtagggctggaaggaacttatccgccgttcagttttcagggggatgacggcaaattaaccggttttgaagtggaatttgcccaacagctggcaaaacatcttggcgttgaggcgtcactaaaaccgaccaaatgggacggtatgctggcgtcgctggactctaaacgcattgatgtggtgattaatcaggtcaccatttctgacgagcgcaagaaaaaatacgatttctctaccccgtacaccatttccggtattcaggcgctggtgaaaaaaggtaacgaaggcaccattaaaacggctgctgatctgaaaggcaaaaaagtgggtgtcggtctgggcaccaactatgaagagtggctgcgtcagaatgttcagggcgtcgatgtgcgtacctatgatgatgacccgaccaaatatcaggatctgcgcgtaggccgtatcgatgcgatcctcgttgaccgtctggcggcgctggatctggtgaagaaaaccaacgatacgctggcagtaaccggtgaagcattctcccgtcaggagtctggtgtggcgctgcgtaaaggaaatgaagacctgctgaaagcggtgaatgatgcaattgcggaaatgcaaaaagatggcactctgcaagccctttccgaaaaatggtttggtgctgatgtgaccaaataatcagcataatgacaaaaaagggcgctttcactagcgccttttttatttacgcgttttcagcgtgcataataagaaaatcacaacaacacacatcggaggctgttatgccactgcataatttaacccgttttccacggctggagtttatcggcgcgccaacgccgctcgaatatctgccgcgcttttctgattatcttggacgggaaatttttatcaaacgggatgacgtcactcccatggcaatgggcggcaataaattacgtaagctggaatttctcgcggcagatgctctgcgcgaaggtgccgatacgctgattactgccggggcgatccagtctaaccatgtgcgccagactgccgcagttgcggcgaaactcggtctgcactgcgtggcgctgctggaaaatccaattggcacaaccgcagaaaactatttaaccaacggcaatcgtttgttgctggatctgttcaatacccagattgaaatgtgcgacgcactgaccgatcccaatgcccaactggaagagctggcgacgcgagtcgaagcacaaggctttcgcccgtatgtcattccggttggcggttctaatgctctgggcgcattgggttatgtggagagtgcgctggaaattgcgcaacagtgtgaaggggcagttaatatttcgtcggtggtggtcgcgtcgggcagtgccggaactcacgccggactggctgttgggctggaacacctgatgcctgaaagcgaactgattggcgtgaccgtgtcgcgttccgttgtcgatcaattgccgaaagtggttaacctccaacaggcgattgcgaaagaactggagctgaccgcatcagcggaaattttactctgggatgactattttgcacctggctacggcgtgccgaacgacgaaggcatggaagcagtgaaattgctggcgcggctggaaggcattctgcttgatcctgtgtataccggaaaagcgatggcgggtctgattgacggtatcagtcagaaacgctgcaaagatgaagggccgattctgtttattcataccggcggcgcgcctgcgctgttcgcctatcatccccacgtttagctccggaaacgctcatgcaagaaagtatacaactggttattgattccttgccgttcctgctgaaaggggctgggtatacgctgcaactcagtatcggcggcatgttttttggcttactgctcgggtttattctcgcgctgatgcgcctttcgccaatctggcccgtgcgctggctggcgcgtttttatatctctatttttcgtggtacgccgctcatcgcccaactgtttatgatctattacggcttgccgcagtttggcatcgaactagatcccattccgtcagcaatgattggtctgtcgctaaacactgccgcctatgctgccgaaacgctgcgcgccgccatttcttctattgataaaggtcagtgggaagctgctgccagtattggtatgacgccgtggcagaccatgcgtcgcgcgattttgccacaggcggcgcgggtggcgttgccgccgctgtcgaacagctttatcagcctggtaaaagatacgtcgctggccgcgacaatccaggtgccggagctgttccgtcaggcgcagttgattacctcgcgtacgctggaggtgttcaccatgtacctggcggcttcgctcatctactggatcatggcgacagtattatcgacgttgcagaaccattttgagaatcaacttaatcgccaggagagagaaccaaaatgagtgccattgaagttaagaacctggtgaaaaaattccacggtcagacggtgttgcacggtatcgaccttgaggtgaagcctggcgaagtggtggcaattatcgggccaagtggttccggcaaaaccacgttgctacgcagcataaatctgctggaacaaccggaagcgggaaccatcaccgttggcgatatcaccattgatactgcacgttcattaagtcagcaaaaatcgctgattcgccagttgcgtcagcacgtcgggtttgtcttccagaactttaatttgtttccgcatcgtacggtgctggaaaacattattgaagggccggtgatcgtcaaaggcgaaccgaaagaagaggccacggcgcacgctcgcgagctgctggcgaaagttgggctggaaggtaaagaaaccagctatccacgtcgtttgtctggcggtcaacagcagcgtgtcgcgattgcgcgagcgctggctatgcgtcctgaggtgattttgtttgacgagccaacgtcggcgctggatccagagctggtgggcgaagtgctgaacaccatccgtcagctggcgcaggaaaagcgcacgatggtgattgtgacgcacgaaatgagctttgcccgggatgttgcggaccgggcgatctttatggaccaggggcggatagtcgagcagggggccgcaaaagcgttatttgccgatcctcagcagcctcgcacccgccagttcctcgagaagtttctgctgcaataataagaaaaaatcagccccgacgattcacctgtcggggcgggacgccatttcaagcgtgataaatctgcttaacaaatcagcataactcattaataacataagagaatgcgatggcttgcaaaagtaattcattgcctgaataatataaattatatataaatcttatttatgtgatagtttgaattatcattataaatgatactcactctcaggggcgttgcggtttactatgcaggatacggattttttcagctggcgtcgcacgatgctgttgcgttttcagaggatggaggccgcagaagaggtctaccatgaaatagagcttcaggctcagcagctggagtacgactactattcgttatgtgttcgccacccggtaccattcacgcgacctaaagtggctttctacaccaattaccctgaggcgtgggttagttattatcaggcaaaaaactttctcgcaattgatccggtgctgaaccctgaaaactttagtcagggccatttaatgtggaatgatgacttattcagcgaagcacagccgttatgggaagccgcgcgcgcacatggtttacgccgcggtgtcactcagtatttaatgctgccaaaccgggcgctgggctttttgtccttttcccgtagcagcgcgcgcgaaatacccattcttagtgatgaactgcaattaaaaatgcagttactggtgcgcgaaagtctgatggctctgatgcgtttaaatgatgaaatagtgatgacgccagagatgaatttcagcaagcgcgaaaaagaaattttgaaatggacggcggaagggaagacatcagcagagatagcgatgattttgtcaatctctgagaatacggtcaatttccatcagaaaaacatgcagaaaaaaatcaatgcaccaaataagacccaggtggcctgttacgcggccgctactggcttaatttgatctcttttctgttctgcgtgccagatgcaaaaaccggctgaaaggcacgctctcagccggttttatattactgacggtaggcttgtttaatttgcttaaccgttttggaaaatactgcagcctgggtttcgtcttcgatcagcgcaagctgtttttccatctttaacatcacgcggcccgcgtcagcttgtcccatcgcctgcagcatcagcgtcagcatcgctttcaggcaggagacttcatttgccagttcttgattattctcggcagtagaaaaatcaggcgtactcatttattttcctcgtcatgttgcaatgaaaatttgcggtgaaaaatgttaaggcggcggagtataccataagctttgctaaaaatagcagtggttgttttttgagcgtgatatcggcagtgctataaaatacgttaatataatgaccaataaatatttttatcatgaatgttttttgcccgtattgttcgggttaattaatgttacatattcagcgggctgattttcatttttgctgaataaagtcaatttttgtcacatttcatcgccgggcttactgtgaaacgatcccggaagccgttggtgacgggcgtgaccataactgtggacaatcgaatttacaaaaacgagagaaaaatcgaatacccaccatttttaacgtttcaaagttgcaataaaaaccgctaatatacgaatgactaactatcagtagcgttatccctatttctggagatattcctttgatcaacgttctacttgttgatgaccacgaactggtgcgcgcagggatacgacgcattctggaagatataaagggtataaaagtcgtcggtgaggcatcgtgcggtgaagacgccgttaagtggtgccgggcaaatgccgttgacgtggtgctaatggacatgagtatgccgggcattggcggtcttgaggcgacgcgtaaaatcgcgcgttccacagctgatgtcaaaatcatcatgcttacggtccatacagaaaaccctttaccagcgaaagtcatgcaggccggtgctgcgggctacctcagcaaaggcgcggctccgcaggaagtagtgagtgcgatccgttctgtctattcagggcagcgttacattgcttctgacatcgctcaacaaatggcgttaagccagatcgaaccagaaaaaacagaaagcccatttgccagtttgtctgaacgtgaattgcagattatgctgatgatcaccaagggccagaaggtcaatgagatctcagaacagctcaatctcagtccgaaaacggtgaacagctaccgctatcgtatgttcagtaaactaaacattcatggcgatgttgagctgactcacctggcaattcgccatggtctgtgtaatgcggagacattatcaagtcagtgagtgatcagtttgacgcaaaagcgtttttaaaaaccgtaaccagccagccaggcgtttatcgcatgtacgatgctggtggtacggttatctatgtcggcaaagcgaaagacctgaaaaaacggctttccagctatttccgtagcaacctcgcttcgcgcaaaaccgaagcgctggtcgcccagatccagcaaattgatgtaacggttactcatacagaaaccgaagcgctgttgctggaacacaactacatcaaactctatcagccgcgttacaacgttttgctacgcgatgataaatcttatccttttatcttcctgagtggcgatacccatccgcgtctggcgatgcatcgtggtgcgaagcatgccaaaggtgaatatttcggcccgttcccgaatggctatgccgtacgtgaaacactggcgctactgcaaaagatattccccattcgccagtgcgaaaatagtgtttatcgcaatcgctcgcgtccgtgtctgcaatatcagatagggcgctgtctgggaccgtgcgttgaaggactggtgagtgaagaagaatacgctcagcaggtcgagtatgtgcgcctgtttttgtctggcaaagatgatcaggtgcttacgcaactcattagccgtatggaaactgccagccagaatctggagtttgaagaagcggcacgtattcgcgaccaaattcaggcggtgcgacgcgtcaccgaaaaacagtttgtgtccaataccggcgacgaccttgacgttattggtgtggcgttcgatgcgggcatggcttgtgtccacgtattgttcattcgtcagggtaaagtgctcggcagccgcagctatttcccgaaagtgccgggcggtacggaactgagcgaggtggtagaaaccttcgtaggtcagttctatttacaaggcagccagatgcgcaccttaccgggtgagatcctgctcgattttaatcttagcgataaaacgctgctcgccgattccctttcagaactggcgggacgcaagattaatgttcaaaccaaacctcgcggcgatcgggcgcgttatctgaaactcgcgcgcaccaatgcggcgacggccttaaccagcaaactttcgcagcaatctaccgttcaccagcgactgaccgcgcttgccagcgtgttgaaattgccggaagtgaagcggatggagtgctttgacatcagccataccatgggtgaacaaaccgtcgcttcctgtgtggtgtttgatgccaacggcccgctgcgtgcggagtatcggcgctataacattactggcatcacgccgggcgatgattatgcggcgatgaatcaggtgctgcgtcggcgttatggtaaagccattgacgacagtaagatcccggatgtgatccttatcgacggcggcaaaggccagcttgcgcaggcgaaaaatgtcttcgccgaactggatgtctcatgggataaaaatcatccgctgctacttggcgttgccaaaggtgcagataggaaggctgggctggaaacgctgttctttgagccggaaggtgagggatttagtttgccgccagattctcccgcgctgcatgttatccagcatattcgcgatgaatcacacgatcacgcgattggcgggcaccgtaagaaacgggcgaaggtcaaaaataccagttccctggaaaccattgaaggcgtcgggccaaaacgtcggcaaatgttgttgaaatatatgggcggtttgcaaggtttacgtaacgccagcgttgaggaaattgcaaaagtgccgggtatttcgcaaggtctggcagaaaagatcttctggtcgttgaaacattgatgtctctgtagcaacataggggtaatcttactgacaacagatagttacccgtcattatgcaatttaatatccctacgttgcttacactgttccgtgtcatccttatcccattctttgtattggtcttttatctgcctgtcacctggtcgccgtttgccgccgcgctcattttctgcgtcgcggcggtgactgactggttcgatggttttctggcacgccgctggaaccagagtacccggtttggtgctttccttgaccctgtggcagataaagttctcgtggctatcgccatggtgctggtaaccgagcattatcacagctggtgggtgaccttaccggcagcaacgatgatcgcccgtgaaattattatttctgcgctacgtgaatggatggcggagttgggtaaacgcagtagcgtggctgtctcctggattgggaaagtgaaaaccactgcccagatggtggcgttggcctggctgctgtggcgtccgaacatttgggttgagtacgccggtattgcacttttctttgtggctgcggtactgactctgtggtcaatgttgcaatatttgagcgctgcgcgtgcagatttgcttgatcagtgatcgtttcggcgcaattttcagcaaacgatcaaaagtggtgaaaaatatcgttgactcatcgcgccaggtaagtagaatgcaacgcatcgaacggcggcactgattgccagacgataataaaatcaagtgattaactgattacttgatgaatgcgggaatagctcagttggtagagcacgaccttgccaaggtcggggtcgcgagttcgagtctcgtttcccgctccagtttaaaagacatcggcgtcaagcggatgtctggctgaaaggcctgaagaatttggcgcgttaacaaagcggttatgtagcggattgcaaatccgtctagtccggttcgactccggaacgcgcctccactttcttcccgagcccggatggtggaatcggtagacacaagggatttaaaatccctcggcgttcgcgctgtgcgggttcaagtcccgctccgggtaccatgggaaagataagaataaaatcaaagcaataagcagtgtcgtgaaaccaccttcgggtggtttttttgtgcctgcaacttgtcgttacaccctccttaatttttaatcaccggcaaagccactcaaaaagtatctctgttacggaccgacatgtaagataggtgctggcgagttgagatccacaaggaaaagcgtatgaaaacgggaccgttaaacgaaagtgagttggaatggctggacgatattctgaccaaatacaacactgaccacgccattcttgatgtggcggagctggacggtttattgacggcggtgttgagttctccgcaagagattgaaccggcacagtggctggttgccgtgtggggtggggctgactatgtgccacgctgggcgtcagagaaagagatgacgcgctttatgaacctggcttttcagcatatggctgataccgcagagcgtctgaacgaattcccggagcagtttgagccgttattcggcttgcgagaagtcgatggcagcgagctgacgattgttgaggagtggtgctttggctatatgcggggcgtggcgctttctgactggtcaacgttacccgattcgttaaaaccagcgctggaggcgattgcgctgcacggtactgaggaaaacttcgagcgggtagagaagatgtcgccagaagcgtttgaagagagcgtagatgccattcgactggcggcgcttgatctacatgcgtactggatggcgcatccgcaggaaaaagctgttcagcaaccgatcaaagcagaagagaaaccggggcgtaatgatccttgcccgtgcggtagtggtaagaaatttaagcagtgctgcctgcattaagagatcaaattgggtgtcagcgttaattctggcacccaataaggaatttgaggctatctgatcaccccacttctggtaacaagcctgctgcaatcaaaaattgcacgctaatcacagcaataccacagagaaacaccaccaccagcgccggacgaccacctttgacccggtaacccgcttgaggattgtgctttctgctttgccaggtcaacagcgaagggataatcaatgccagtaccgccagcgccacaccggcgtaacccagcgccatcacaaatcctcgtggataaaacagtgcaaacgccaacggcggcagaaaggtaattgcaccagtttgcaatcgtccaccaacggtatttgaacgctgaaacaaatctgccagataatcaaataaacctaacgcaacgccgagaaatgacgtggcgagggctaaatcagcaaataaatgcaccgccagctcaacatgcggagaggccaccatttcgcgtaacgcctgtaacagcccgtttaacccggcatgattagccagcaatcccataaaggttgttgaatcaatgctgccaagcgtcgccacctgccagaaaatatatgccaccagggggatcgcactaccgattataaacacccagcgtagcttacgaatgttgccatccatatagctgacaatactcggcacgctaccgtgaaaaccaaacgatgtaaaaatcaccgggattgcagatagtgccagcccctgttgcaacggcagggttaaaagattcaccttgtgaatatgcggaagcagcagtaccagcatcaccaccagaaaaataattttggcgctgaacagaaaacggttaaacaaatcgaccagcgatgtcccgacacaaaccacgccaccggcaacaaaagtgaacaacagcacgccagcggttgccgacattgaaatacctgtccagtcgctgatgctggaggccaacaattcaccggcaccgctgatgtatgccgcagttagagcatacattaagaacatcatactgaagcccgtcagccactgaccgtagcgtcccagatagcgttttgccagcgtgccaaggccggtatctgccgggacatgctggtacacctccagcagtaatagcgccgtgtagcacatcaacgcccaaagcccaatcaacaagattaacgtgacgctaaaaccaacacctgccgcagccagcggcattgccagcatgcctgcgccaattgtggttcccgccacgataaaaacacttcccagagttctgtttttcacgctttcttctgtcctgacgatctttatgagtgatatctgcggcgcaggttaaggcataacggctggttcgtcaaaccggcgttacatatggtgtaaatataaatgtacaataaaatgcgttcagtcctgcgctggcgcaaagtcttggtaagcggcaatcgctacgctagccttttttcgaggaggaacgatggactctattcacggtcatgaagtgttaaatatgatgattgaatcaggtgagcaatatacgcatgccagtctggaagctgcgattaaagcgcgttttggtgaacaggcacgttttcacacttgctcggcagaagggatgacagcgggagagctggtagcgtttctggcagcaaaaggcaaatttataccttcggaagacggtttttcgaccgatcagagtaagatttgccgtcactgatttgaaacggcggcagaaaacctgccgcctgagagcattagttttgtgtgtcgagggtagagagttctttgtcgataaaatacagaccttcgccgcttttgcctgccaggcttaatttatcaataatcgatttgaacagtttctcttcttcatgctgctcagaaacataccattgcaggaaattaaatgttgggtagtcctgattggtcattgcagcatgagccagttcgttaattttctgggtgattaattgttcgtgtttataggtttcctggaataattcatcaagtgaggaatattcagcaaacggagattcaacggtattaatacgcggtaaattgccggtatcagtcagataatcaaacagacgctgcatatgcgtcatctcttcctgggcgtgacggcgcaggaacgcggcagcaccttcgaaggtatgatagctgcaccaggcgctcatttgctgataaagcagtgaagagtacagttccaggttcatctgctcattaagtttttcaatcatttctggtttcagcatgatagtgctccacaaagattatatttgttgctgtggcgtcactataatttgttattttattatttgcaaaaggtaaaatataaacttcatttattaaaaatacgaatgggaataaaacgcattaccgctatttctttaatcagcgaagatcccctcgctgattaaaatatttagggaaggtgcgaataagcggggaaattcttctcggctgactcagtcatttcatttccgatggtagtgtggggtctccccatgcgagagtagggaactgccaggcatcaaatttagcgtgctgatatggctcagttggtagagcgcacccttggtaagggtgaggtccccagttcgactctgggtatcagcaccactttttaggttaaagttcggcagattagaaaagaatttgtctggcggcagtagcgcggtggtcccacctgaccccatgccgaactcagaagtgaaacgccgtagcgccgatggtagtgtggggtctccccatgcgagagtagggaactgccagacatcaaatcaagcgaaaggccatccgaaaggatggcctttttgcttttcgaactaacattcaattaatggattacctgcgataaaaatgccctcgtacgctctgatttaggatgcgcaaaaaattcatcaggtgcagcttgctccactatttccccacgatccataaaaatcaccctgtcagcgacggttcgtgcaaaccccatctcatgtgttacacacaacattgtcatacccgactgcgccagcccaatcatcgtatccagcacttctttcaccatctccggatcgagcgctgacgtaggttcatcaaatagcatgatctttggtttcatacaaagtgaacgtgctatggcaacgcgttgctgctgaccaccagaaatctgtccgggaaacttctgggcatgttcggcaattctcacccgctcaaggtaatgcaacgccagatcttcagcctctttcttaggcatcttgcgtacccaaatcggtgccagggtacagttctgtagaacggtcagatgagggaagagattgaaatgctgaaagaccattcccacttcctgcctgacgcgctcaatattgcggatatcttcattaagttcgatgccatccaccacgatccgtccctgttgatgttcttccagatgattaatacaacgaatggttgtcgatttaccggaaccagaagggccacacagaacgatccgttctcccggttgcacggttaaatttatatttttcaaaacatggaattgcccataccatttattgacgttttccagcgtaatcatcgcgttagcaggttgcagtaaaatttggctcatagtgtcctcaatgcggtgtacgcccggtgttaaaacgtttttccagatgttggctataacgtgacatgctgaaacagaagatccagtagatcagtgcggcgaaaacatacccttccgtcgacatacccaaccaggcgggatcaacggttgcctgctgaacgctactgaaaagatcgaacaacccgatgatgatcaccaggctggtatctttgaagagtgcgatgatggtatttaccagcccaggaatcaccagcttcaacgcctgtggcagaataaccagcccctgggttttccagtaacccaacgccagcgactctgccgcttcatattgccctttaggcagcgcctgtaatccgcctcgcacgacttccgcaacatatgctgactgaaacaggatcacgccaaccagcgcgcggatcaatttgtcgatactggtgccttctgccataaacaacggcagcatgaccgaagacataaacagaacggtaatcagcggtacaccgcgccagaactcgataaaaatgaccgataagatacgcacaatcggcatatgggagcggcgacctaacgccagtaagatcccccacggcagcgcccccgcaatcccaactgatgcaataattaaagttagcgtcagcccgccccattgccgggtttcaacccgctcaagaccaagaaacccgccatacatcagccaccagacaatcagtgggtaaatcaccgcccataccgcaatatagcgaccgcgattcgggagtattttccagaacattggtgcgatcgacacaagcccaatcagtaatgcgaggttaattcgccagcgttggtcgtgtgggtaaagcccatacataaactgaccaaatcgttcgtggatgaagacccaacaggcaccggcttttgtgcagtcggtacgcgttgagccaacccagttagcctgcaaaaatgcccagttcagcaacggtggaatcagttcccacatcaaccatatgcagccaatagtcagcaggctattgctccagctggagaacagattttttcgcacccacaccatcgcgcggcttgagttatggctcgccgggcgcgggggatgagacagcaatacttttgtcatcatgactccttagcgttcaacgatcgcgatgcggcggttatagatattcatcagcagcgagatagtcaggctgataatcagatagaccgacatggtcatggctatcgtctcgatggcttgccccgtctggttcagcacggtgccagcaaacagcgaaaccatatccggatagccaatcgcggcggcaagagaggagtttttgacgatgttgagatactggctggttaacggcggaataatcactcgcagtgcctggggaataatgacctggcgtagcgtaaccggattgggtaatcccagtgaccgagccgcttcatgttgaccataaggcactgcctggatcccagcgcggataatctcggcgataaatgcagaggtataaaccgaaagcgccagcgttaaggctgccagttcaggaattaaaaccatcccgccacggaagttaaagcctcgtagggctgggacatcccagtgtagtgctgcgccaaaaagccattgcgccagtaaaggcaaaccaatgatcaacacagcggcgatcggccaggtgcggcgcagttgtccggtctttatctggtatgttttattaaagcggaatagcccaacagaaaggactatagccataacaacagccaggataaacgcaataaatccgtctcccagctgcggtgacggaatataaagcccacgattgctcaaaaaggccagatcaaacgcgctcacagcctggcgtggtccgggcaaattgcgcaacacggcaaagtaccagaagaagatttgcagcagcggcggaatattacggaagatctcaatataaattgtggaaagctttcgtagcagccagttatccgaaagtcgagccagaccgataaagaagcccagaacagaagcgaatacaatacacaatgcagaaaccagtagcgtattgagtaagccaacaatgaaaacgcgtccgtaggtatcaccctgctggtaatcgatcaaatgctggacaataccgaagccagcgccgcgatccagaaaggcaaaacctgaagtaatgccacgattactgagattcgttacagtgttgtgaaataaccaaccaacaatgccgataacagcaacaacggcaaggatctggaataaccaggcacgaaccgtagggttggcaaaggagagtgagcctttaacggttgagcggcgatgagacatagaaacctcggaaagcataacgctgaagagagcgccgccgtagcgacgctcgttacctcacaccgacttaacgcacgggcggcgcgtactgaataccgccgttattccagagattattttgcccacgtttaattttcagcgggctttctgaacctacgttacgctcaaaaatttccgagtagttacccacctgtttgatgatgttataggcccatttattatccaacttcagatccttgccgtaatcgccttctttacccagcaaatgtgccatatcaggcgttgctggattagccgctttttcatcgacgttctgggaattgatgcccatctcttcagcattcagcatggcgaaaagcgtccagcgtacaatcgagaaccattcatcatcgccacgacgaactaccggcccaagcggttctttggagataacttccggtaagacaatccattcagccgggttgcttaatttgatgcgcagggcatacagttgtgattgatccgaggccagcgtatcacagcgaccagattccagtgccttcgctgattcgtcagagcgatcgaaagtcactggtgtgtacttcatattgtttgccttgaagtaatcggcaacattgagttcggtatcagtacccgcctgaatacagacagtagcgccatccagttctttcgcgctttttagccccgctttatcgtgcgtcaggaagccaatgccgtcgtaataagtgacgccagtaaatgccattcccatcccggcatcgcgagatgaagtccaggtcgtattacgggagagcaaatccacctcccctgactgtaaagccgtgaagcgttcttttgcagtgagcggggtatatttcactttcgtgtcgtcaccaaatacagctgccgcaacaccacgacaaacatctacatcaatacctgaaaacttaccgtcagcatcggcataagagaacccaggtaatccatcactgatcccgcattgcacaaaaccttttttctgaacggcatcaagcgtcgcgccagcatgcgcctgatttgcaacggcaagcagcacgctggcggcagccagtgtggctatcatcatctttttcataatgcttcctgtgaggcgaaaattatcgttataggacgtttgggaaacgtcttttacctgtctgtggccatcctcttataagcaaaagtagtgccagcttttgcgcacgatttcgcgtcgcaataagctgagtgtagacaggaaataataaaaacagcgccccgcaatggtgcgaaaatgaaacatgcgccacattttggcgcaaaatatttacgcgttttttactaagcagaataatgattgttagcgtgagtataattctggtgggaagtgtgaaaattaaattgatgcgttatttcgaaagcagcgaaataacgcgatataacatgctaaatcagcagggaattagccagcagaatatagcaatattttatcttatggtgagatactgtatcgttaaacagagtgcggtactccgcgccctgtgcagttatttcgacagagcgatgatccccatcgtcaggccagcaacagctgctgccccgccagcaatagccccagccgtttcccagttatcctgagtcgtgcctttcatacaggtattagtgtgaaccagtcgaccctgatcgtcataaaccggaacgcagggcgaatcgtgagcacagcccgccagcaatgcggtgagcaatgccacaggaattaatcttttcatggtgttacctcagtaataaacgctaacgcttaataagttaactctcttattaacgagctgaatgccattttatcaccggaggttataaatcttgcggaatgaataatgacaaattatgtgaattgtaaaaatagtgaagggagcgggaactatagaaagtttttaaagagtgagaagaagaatatcttattaatttttatgggtttcactgaaaataataaaggcacccgaaagtgcctttatgtttctgatttatcctttaaagcaacggcggatcaccacaaagaacaccggcacgaagaagattgccagcaacgttgcagaaaccatcccgcccattactccgatacccactgcgttctgcgcgccactgccggcaccgttactgatagctagcggtaatacgccgagaataaaggcgagagaggtcatcaggataggacgcagacgcatacgtactgccattagtgtcgcttcaacaacacctttaccctctttctccatgagatctttagcgaactcaacaatcaaaatagcgtttttagccgacaagccaattgtcgttagcaagcccaccataaagtagacgtcatttttttgattaaagagtgtcgccgccagtagcacgccgacaatccctaacggcacgaccaacataaccgagacaggaattgaccagctttcatagagtgcagcaaggcacaggaaaacaaccacaaaggaaattgctaccagagcgggagcctggtttcccgataagcgttcctgatatgacatacccgtccagtcataaccaatgccagctggtaattgtgatgcaaggttttccatcaacgccatggcatcgccggaactggttcctggcgcggcttccccctgaatctccattgacggcagaccgttgtagcgctccagtcgcggagagccatacacccaatgtgcagtggtaaaggccgagaatggcaccatttcgccgttggcgctgcggacataaagtttatcgacatcttctggcagcatacggaatttggcatccgcctgaacatacacctttttcacgcgaccacggtcaatgaagtcgttaacgtaagtcccacctaacgccgttgaaatggtctgattgatgtcagaaagtgaaacacctaatgcctgcgccttttcctggtcaacttccagtttaaactgcgcggtgtcttccagaccattaggacgcacgctgactaagctggcaggatgttgcgccgccatgccaagcaactggttacgggcctgggtcagggcatcatgacccagcccagcctgatcaattaactcaaagtcgaaacccgttgccgtgcccagttcaacaatggctggcatattgaatggaatgacaaaaccgtcgcggatcttgcccaattccattttggcacgatggattaccgcttccgcactgttttcgtcaccactacgctcttcccacggtttcagactgacgaaagccataccggcgttttgtgcctggccgctgaagctaaagccgttaaccgtaaagacactttctacgttcgctttctcgttcttcagatagtaatccgtcacttgatccaacactttttgcgttcgctcttgcgtcgcgccagcgggtaactgaatcatagtcagaaagacaccctgatcctcttcaggtaagaaggaagacggaagacgtaaaaacaacaccaccattccagcaacaattagtgcatagatcagtaaatatcgtcctgtggaaccgagtattttgccgacgctgttggtgtagtggttaacgctatgatcgaaggtggtattaaaccagccgaagaaaccgcccttattttcgtgatgctcagcagagacgggtttgagcagtgttgcacataacgctggggtaagaatcaatgccaccagaacagaaagcgccattgccgaaacgatggtgatagagaactggcgataaattgccccagtagaaccgccgaagaatgccatcggaataaataccgctgacagcaccattgcgatacccaccagtgcgccctggatttgcgacattgatttttccgtcgcttcttttggcgggagcttatcctccatcatcacgcgctcgacgttctccaccaccactatcgcatcatcgacgagcagcccgatggcaagcaccatcccgaacatcgttagtgtgttgatggagtaaccaaaagcggcgaggatggcaaacgtccctaacaacaccacgggtaccgcaatggtggggatcagcgttgctcgcatattctgcaagaacagatacatcaccaggaacaccagcataatagcttcgaacagcgtttttaccacttcgtgaatagaaagctggacgaatggcgtggtgtcataagggtagagaaccttcattccctgcgggaagaatggctgtaattccgccagttttgccttaatggctttcgcggtatcgagagcattcgcgccggttgccagcttaatccccaggcccgccgccggtttaccgttgatgcgagcgataacgttatagttttcaccgccaagttcaacccgtgcgacatctttcaggcgtaccaccgagccgtcactgtttacgcgcaaggtcactttgccgaattcttccggattttttaaccgcgtctgagcaataatcgaggcgttcaactgttgccctggtaacgctggcgttccgcccaactgtccggcagcgatctgatcgttctgtaccttcaactggttaatcacatcaacaggcgtcagtttatatttgtttagcagatcggcgtccaaccagatacgcatcgcatactgtgcgccgaaaagctgtacgtcaccgacgccattcagacggctaagcgtatctttaacgttagaggccacatagtccgagatatcgtcctgtgtggtgtctgggttatcagagacaaagcccgccaccatcaaatagctgctactggacttttcaacactgatcccctgctgctgtacttcctgcggcagcaacggcgtggcgagctggagtttgttctgcacctgcacttgcgcgatatcaggatcggtcccggactggaaggtaagggtaattgtcacgctaccggcggaatcgctggtggaggacatatacatcaggttatcgataccgttcatattctgttcgataacctgcgtcaccgtatcctgcacggtctgcgcatcagcgcccggatagtttgctgaaacagaaaccgcaggcggtgcaatggttgggtattgggcgacgggcaattgtaggatcgccagtgcgcccgccatcatcagaataatggccagcacccatgcaaatatcggtcgtcgaataaaaaagtttgccatgtcagattgccttacttcgatgcagaatctgcgggggtatcggtagtggctttaacctgctctcccggacgcgctttttgcaggccgctgacaatgacttgatcgccagatttcagaccttcgctaatcaaccatttatcgccaatcgcctgactggcaacgacagggcgcgcttcaacctggcttttatcgttaacaatcagcacggttgcatcaccacgcggtgtgcggctaacgccttgttgcgggataagaatggcgtcaggttggacgccttcatcaatccgtgcacgcacaaacatacccggcaaaagcgtatgttgcgggttagggaagacagcacgtagggttatggagccggtgctttcatcaacggtcacatcagagaattgcagcgtacctttcaggggataggtttgaccgttttccatgaccaactctacgttgctggtggcgttttccttatgcaaatttccttgctctacggattgcttcagcctcataaaatcgttgctggattgggtcacatcaacgtagataggatcgagctgctggacagtcgccagttcagtcgtttgcccattagtgacaagagcgccttcggtcacggtcgatttgccgatacgtccgctaattggcgcagtcactttggtataagcgagattgatgcgagcgctttcgaccgtggcttttgcggcaatcacggcggcatcggcctggcgagcatcagcaatggcctggtcgtactcctgctgactgatgtatttcgtacccacgagcggaacgtaacgttttaccgtcaaatgcgcgatggcggcggcggcttcacttttcgccagttcgcctttcgcgctgtcataacttgcctgataggtcgcgggatcgatctggtacagggactggcctgcttgcacatcgctgccttcagtgaaattgcgattcagtacgatcccgctaacctgtgggcgaacttcggctatacggtaagcattggtgcggcctggtaattcagtcttaacttctaacggggccgttttcacaatatgaacggtaacctgcggttcaccgacgtgagctttctcttctcccttatcgttacaaccggcgattaaagccgcggagatcagaataaaggagggcaggaggaaaaacctggcatgtttcgtcattactattcctcaaaaaaccaaaagcgcgttatttacccaaaaaggcaacgcgttaactcgcagaaagaaaaatacagttcgctatcctacaaattatcattcgtcgatgtaaggaatagttatgaatactggcgtctcaaggcacataaacacaaaaaaagattaatattctactgttttattttgacgcgggttgaaagaggtagaatcaaatcctcgtaaattgaaatatatattgatagagtgaatgtattttaggtaaataataaacgttatttatttgacgatttatagcaactcaatattagcctctcgtataaatatacattaggtgatagattaaccttcgctattttctcatcctgtgtcgaatatatttatttcctgaataattaatcatggcaaaaagaaccaaagctgaagccctgaagacccggcaagaactgattgaaactgccatcgcccagtttgcgcagcgtggcgtaagcaagacgacgctcaacgacattgccgacgccgctaacgttacgcgtggcgctatctactggcacttcgagaacaagacccaactgtttaatgagatgtggttgcaacagccttcattgcgggagttaatccaggatcacttgactgctgggttagagcatgacccgtttcagcaattgcgtgaaaaattgattgttggcttgcaatatattgccaaaattccccgccagcaggcgttgctgaaaatcttatatcacaaatgtgaatttaatgatgagatgctggcagagggagtgatacgcgaaaagatgggttttaatccgcagactctccgcgaagtattgcaggcatgtctgcaacaaggttgtatagcaaataatctcgatttagatgttgtgatgattattattgatggtgccttcagcggaattgttcaaaactggttaatgaatatggcgggttatgatctttataaacaagcacccgcactggtcgataacgtattaagaatgttcatgccagatgaaaacataacgaaattaattcataaaacgaatgaattaagtgtcatataaattcacattctgtcctgaaaattcagttcgtcacagttaaccagttttagtggattaactgagttcatattgcggcatttgtctgtttctgttgcgagcagttcaatccactgcatcagtaaagtatcaaacagaaaaacgaagacagcgaaaacgacgagccaccaatacttgcgaatcattacctgagcctgtgcatgtttaaccaagtctggcaggaaatatacacgaaatgaataatctgaaaaccaggcttacacttcctttactttgcaatgagatcggggtcaacttcgcttaacctgcttcgttttgacaggttgccggtctttctttttttcactttcgccagttcttccgcagagtaatgcgacgcgacatccagccgtcgaagccccattttgatgtactcgctgttgatctcaataccaatgaattttcgcccactggcgacggctacggcaccggtagtaaagctaccagcaaacgggtcgagaacgatatcgcctgggttggaagagccgagaataatgcgtttcagtaaggcttccggtttttgcgtcgggtggttttcatattcatccatcaaataacgcacgcgcggaaaatcccagacgttacccggtactttttgatgattgtaaggctgtggagggtttttgcgataatcgatcaacgcgcgctgcgatccggttttggcttctaccagaatagcatcaccgttgaatgtgtagttctttgcgtctttcaccatcatcaggatgggttcgtacatggagccgtagtgttttttcgcctgcactccagaactgtcatatgaccagacgatgcgacttttgatggtaaaaagcttgcggcactggagatcgataaagggcatgttttccgtgctattcatgatgtacatgctgccctgctttttcagaacgcgatggcactctgcaatcacttcaaacagccagtcgataaacagatcttctttccaggcttcgatcagaccatcaaaatttttaccgatgttatacggtgggtcggcaaagatcagatcgacactttcggcggggagctttttaagttcggttaatgcatcaccctggatgatggtctttgcttcattaccaaatcgggtcggttcacatcctgttctcatggtcactccctttgtgacacctataaaaaaggcgcttccccatgccgagtagcgcctttttaatcaagcatttagctaacctgaattagttcatgccgtattttttcaattttttacgcagcgtaccacggttgatgcccatcatcagcgcagcacgggtctggttaccacgggtgtattgcatcaccatgtccaacaggggctgttctacttcagccagtaccagctcatagaggtcattcacatcctgaccgttcagttgagcaaaatagttcttcagtgcctgtttaaccgagtcacgcaggggtttttgggttacctgatcctgagagttaacggtagaaacggtcagtacgtcagaatttacgcgttgttcgaacatagttctgtcagctctttatttctgtttacgcaaaattttcgaagtatgcctccaacgcctccagctgttcgctggcatcctcaatggcgttgaatgtgcgccgaaactggtcatttggagcgtgttcctggagataccaggaaacgtgtttacgtgcaattcggtacccttttgccggaccataaaagtcatgcagttcccgaacgtgcgcgcaaagcaagcgcttaacctctgccaaaggcagcgggggcagcaactccccagtgtccagataatgctggatttcccgaaagatccagggtcttccctgagctgcgcggcctatcatcaaggcatccgcccctgtatagtcgagcacagctctggctttaagcgggtcagtaatgtcgccattcgcgataaccggaatggaaactttctgcttaactgcccgaatactgtcgtactcagcttctccattgaacaaacaggcgcgtgtacggccatgaatggtcagagcctgaatgccacagtcttcagccagttgggcaatctcttcgcagttacggtgttccggtgcccagccagtgcgaattttcagggtaacaggaacgtccactgcattgacgacctcggtaaggatcgatttaacgacatccgggtactgcaagagggctgaacctgcgagcttgcgattcacttttttagccgggcaacccatattgatatcaataatctgggcaccgctttccacgttaatacgtgctgcatctgccatttctttcggatcgctaccagcaatttgcacggtgcgaataccgggttcatcaatgtgcaccatccgtaaacgagatttgtcgctttcccaaacctgagggttagaagacatcatctcggatactgtcaatccggctcccatctcgtagcacaacgtccgaaaaggtctgtctgtaatgccagccatgggcgctgcgatcaggcgatttctgagctgatattgtccgatgcgcatgagttaagaaatgaccatactgtgactgcaaggcggcgtatattacgcattttttgcacgagatgaaaggccaaactttgaccaatcctctgagatggatcaaagaattgcatttaaaatgagcgtagcgcgataattactcataaaaatcatcatattagaaaatagtgactaaaatttacactcaaagaaatttgagtaagttctcaatttttctttatgaatgaaaattttggcacgcaaatttgcgtaaataatcggcaaattaacgtgccttttgtgacatcgctcgcacttcgctctgcgtcaccctacggcgatgcgaaggttaattcttacgaccggtaatgcggcaccactcttctttttccacgaccgggtccagagcgaagctgtcggcataagcttcgcaaacgctctctgcctggcttgccagaataccggaaaggcccagcaaaccgcctgaaactggcaggacgctgattaacggtgccagttcacgtaatgggcctgcaaggatgttagcgaccaccacgtcggctttcatttcttctggctgatctttcggtaagtagagttccagacggtcagagacgccattacgttccgcgttgtcgcggctggcctgaatcgcctgcggatcaatatcaataccaatggcttttgctgcacccagtttcagcgccgcgatagccagaatgccggaaccgcagccaaagtcgatgactgttttaccggttaaatcgaggctgtcgagccattgcaggcacagagaggtagttggatgggtacccgtaccaaacgccagccctggatctaacatcacgttgacggcgttttcgtccggcacatcacgccagcttgggcagatccacagtcgttcaccaaagcgcatcgggtggaaattatccatccattcgcgctcccagtctttatcttccagttgttcgattttatgcgcgaagcccgcgccgagcagcggatggttttccagaatcgccaccacgtcgttcatatcggtttcagcgtcgaacagaccaatcacatcggtatcgccccacaggcgcgtttcgcccggcagcggctcaaatacaggcgtatcgtgggtatcctgaaaagtgatagaaacggcacccgcttccatcagcgcatcgctaagatcttccgcgttcgcgccggtagtgttcagtttcagttggatccaaggcatggcaaaactctttatttatcagtagtcaaaacggtagcttgcgggacggatgtaccgaaacggtttccgaccaggaaagccagcaaacttagtagtaacgagggcacgatagggtggaagcccaggtactgaatattcagcgtcgcgagtacggcatacagtacgccgccaacaatcatcgcacttagcgcgcctttggcgttggcgcgttcccagtaaagacccagtaccagcggccacaggaaaacggcttccagcccaccgaaggccagcaaattcagccagatgatcatttctggcggcttccaggcggcaagcagcagcaacgcaccgagaactaacgtaattaccgccgacatccgcttcagacgcgtctcgttttgcatttgatccggacggatattcaaatagagatctttaatgatcgtagcggaactttgcagcaactgggcattgatcgtcgacatgatcgcagccataggtgcagccaggaagatcccggcagcaaacggtggcaacacttttaccattaacgtcgggatcaccaggtccggtacggtgagatcggggatcaccgcccgacctaacgctccggccaggtgcataccgaacatcaggattgcgaccacaatcgtaccgatgatgatcccccgatgtacggctttgctgtctttataagagatacagcgcaccgcagtatgcggcaggccaatcacgccaaaacacaccagcacccagaacgacgtcataaaggcaggcgacagaatatcgtcagcgccttgtggcgtaaccagttgcggatcgatggtttgcaacgtctctactgcgttgcttaagccacctgcggcatgtaccacgccaataagcagcacaatggtgccaatcagcatcaccagcccttgcatggtgtcgttcagcacgctggcgcgaaagccgccgaaggcggtgtagagcgcaatgctgatgccaaaaatcagcaaacctgtttcataagggatacccgccgcggtttccagcagacgcgcaccgccgataaactgcacggtcatcgcaccaacgaacgcaaccagcaaacttaaactcgccagccacaccagcagacgactctggtagcgggcaaatagcatatcgttcagcgtcaccgcattgtagcggcgcgcaagaatcgcgaacttcttgccgagaataccgagcgaaagccagaccgcaggaagctgaatcatcgccagcaatacccaacccaggccgtatttataagcagcgccaggcccgccgataaacgaactggcactgatataggtcgcggtgagcgtcatcgccagcacaataccgcccatagagcggctgccgaggaaatactcattaaggaaggtgccggtgctccgtttacgcatcgcataaacagagataccgaacaccaccaccagataggcgaccagcggtagaatcacttcaagctgcatcgtcatcctccagtgggatatcgcgatagataaatttcaccatcgcccagcacagtccaataaacagcagcggcgtcaggatgcaggccatctcaaaccagcgcggaaagccggtaaaaccgggggcaacgccaggtaagtaagcggctactaaccataccgccagatacaaaagggtcagccccagcgcccagcgcgcctctttatgggcctgaacaaaacgagtgtccattttttgtccctgatgggtgaagaaagcggggattgtaccttatgggggttgtcgatccccagtaataaaaaaggccggaaaatccggccttttgacgcttttgcagtcttatttttcctgaagaccgagttttttctccagatagtggatattagtaccaccatgctggaagttctcgtcattcatgatgcggatctgcagatcaacgttggttttgataccgtcgatgatcagctcctgcagcgcattcttcatgcgggcaatcgccacgtcacggttttcaccgtagcaaatcagcttaccgatcattgagtcatagtacggcggtacggtgtagcccgcgtagatatgagactcccaacgtacgccaaaaccgccaggtgcgtggaaacgggtgattttgcccggacttggcaggaaggtgttcggatcttcggcgttgatacgacattccaccgcatggccgcgaacgtgaacttcttcttgcttgatcgacagcggttgaccggcagcgatacgcagctgttctttgatcaggtcaacgccggtgatcatttcggtaaccggatgttctacctgaatacgggtgttcatttcgatgaaatagaactcgccgttttcgaacaggaactcgaaagtacctgcaccgcgatagccgatatcaacacacgctttagcgcaacgttcgccgatgtagcgacgcagttccggggtaatgcccggtgctggtgcttcttcgaccactttctggtggcggcgctgcatggagcagtcacgttccgccagatagatagcgttgccctgaccgtcagccagtacctgaatctcgacgtggcgaggattttccaggtatttctccatgtaaaccatatcgttgctgaaagcagctttcgcttccgcacgggtcatggagatggattgtgccagttcagcgtcgccgcgcactacgcgcataccgcgaccgccgccgccgccggaggctttgataatcaccggataaccaatgcgtttagcaatggcgcggtttttatccatatcgtcgcccagcgggccgtcagaacccggtacgcaaggaacgcccgcttttttcatcgccgcgattgcggatactttgtcgcccatcaggcgaatggtttctgctttcgggccaatgaagataaagccggagcgctcaacctgctcggcaaagttggcgttctcggagaggaagccgtaacccggatggattgctactgcgccggtgatttcagcggcgctgatgattgccgggatgttcagataactttttactgacggagcagggccgatacagaccgtttcatctgccagtaatacgtgttttagatcgcgatccgcgctggagtgtacagcgacagtcttgatgcccagttctttacaggcacgaagaatacgcaatgcaatctcgccgcggttggcaataacaattttatccagcatgttcgcctcgttactcgatgacgaccagcggctcgtcaaattctaccggttgtccactttcgaccagaattgctttcacggtaccggatttgtccgcttcgatctggttcatcattttcatggcttcaacgatgcacagggtatcgcccacgttgactttctgacccacttcgatgaacgctttcgcgtccgggcttggggtgcggtagaaagtaccaaccatcggggaacgtacgatgtgaccactgatttccgctgctgctggcgcttccatggaaggaacggtcgccggagcggctgcgttagattgagctggctgctgcatcattggtgcagcgtaagcttgttgcatcacagggaaacttgcggcaggagctgcacggctgatgcgtactgactcttcgccttcggagatttccagttcggagatgcctgattcttcaaccagctcgatcagttttttaatcttacgaatatccatgagtgggttccgtactctttgtttagtgtgattgtgacaggcgtttcaccgccgtctgtaaagcgtatgccccgacagctgtatgcatagcgataaattccagcaggccgggacgccggtctattttgccccagagtgtcaatgttagacttgacggacattgtgcagcgatctgctgctatcctccggcaaaaaacaaaatataccttcgttgcgccaatgtcaccttttccgcagcgcaaaaactgcgtcagggaggacgaggtcgcacattataacgatttcgtagcaattggcagctaaatactggtcttatcagggaagataatcaacagctaacatgtaaataaccttcaacaccgtgtaatttgcaacaagccgcacaattcacgaaattagcgccatcatcgacggaacttcttataacgtaaggctaaaagctgtaaagccagccctgcgaagatgaggggctgcaatgagataatcttcacagaccacaaataatgtagggatgccaggatcgcgacaagatagacgacattacgcagcggttgctgaggattacgcaattttcacttcatcgtctggataaacgtgaatgctaaagcacgcaaaatcaaccgcctgacaatgctctgcatgaaataggtttaagtggttaatttgtaatcaaataaaatcagattattccccccattttgcagaaggtaaactgttttgtcaggcggcagtgcggctatgtgatgcattcagaatttgccgcgtgacaataaaaaagccgatttagtagcaaaatcggcttcggtgagtttgcagcattcatcacatactccgacaagctttttcaagcatgacggaggttgcgttaatgcaaggtttctacccagggataaaagtgaccgttacggcggatgaatatctgtgttgtcagaggatggtcatcctcacggaagcattgttctgttaactgtcgtaatgcgctgagatttgctggctgatcattgtgggtgaaaaacagttttcctctggagggaacggtcactaacaggtcgccgcattcaggatcgggtgattgcacccaaagatcgtcaatgagcatcagactgggctcataagtaccccctgcggagataacggcaacttttccatcgtttgcgcctgtatcaacgatttcagccgtaacttccggcaatatttgcttcaaattactgatggcttgttcgcggtcaatggtcacttcgcagcgcatcagatagcgcatggtttcgctaccgtcttcagcaaacaggataattaactcatcgttaaagtcttcccaggcaaaatcaagcgaggcgttgaggacctctggatcagactcatactggctaagctgttggcgaacggtatccagccaggctttttctttaatcaccgggacaatacagcgcccggtcggcagcatttctgcaagctgtttcagcatatctgcagccacttcttccagcgggtctggtgcggcttgataacgtttgtaagcatcatcaagggtgatttccacagtttggtgacccgtatcaatgcgcatcaatttgtggtcagtcgaaatcatgactttccagtttggatgatgttgtacaacttcatgaccaagatgttcgacgaaagctgtccggctaaccgcttttcccgttaaccgattgaataatgatttcaaaatgagttccctctcttattaatccttgctaaatggttagttaaccttcaccagcgtgcgaccctggatctggttattaatgatggcctcggcaaacttcggtgcctctgccagagatatctcttttgccgcctgggtatagaatgattccggtaaatcggcgaccagtcgctgccaggcttgtgcgcggcgtgctggtggcgtcatcactgaatccaccccctgtaaacggacattacgcagaataaatggcatgaccgtggttggcagagtaaaaccacccgccagaccacaggccgccacgcagccgccgtaattcatttgcgctagcactttcgccagcactttgtcgccaacggtgtcaattgccccagcccagagttgtttttccagaggacgggattcggcaaactcatcgcgagagagaatacggctggctcctaaacttttcagatattcatgggtactttcgcgaccagaaacggcaacgacctgataacccaacttatgcagcagcgccacggcggtactgccgacgccaccactggcacccgttacgacaatctcgccgtcctgcgggcgaacaccggcatcttccagcgccatcacacacagcatggcggtaaaaccggcagtaccgataatcattgctttacgcgcgtccagcccttgcggcatggcaaccagccagtcacctttcactcgcgcctgctccgccagcccaccccagtggttttcaccaacgccccagccagtgagtaatacctcctgaccggcatgaaaacgcggatcttcgctggtgcgtacagttccggcaaaatcgatcccaggaatcatcggaaaattacggatgatttttcccttaccggtaattgccagcgcatctttgtagttcaggctcgaccagtgaacatcaaccgtgacatcgccctccggcaggcgactttcgtccagagtctgtaccgatgcgagagttttgccgtcctgctgttctaaaagtaacgcctgcataagtggtcctcatgtgcatgatggattggaaaataatttctgaagactatactcgctaatggaaaagcaaagccgatgaagcgcaataaattgcgagataaatctgatttgctagtatgcccgcttcctcactatcggagttaacacaaggatgagattaacgacgaaattttcggcctttgttacgctgctcaccgggttaacaatttttgtgactttgctgggctgttcgctaagtttctacaatgccattcagtataagtttagtcatcgcgttcaggcggtggcgacggcaattgatacccaccttgtgtcgaatgacttcagcgcattaaggccacaaattaccgaattaatgatgtcggcagatatcgttcgtgtagacctgctgcatggtgataaacaggtatataccctggccagaaatggaagttatcgtccggttggcaccagcgatctgtttcgcgaactgagcgttccgttgataaagcatccggggatgtcgctgcgtctggtttatcaggatccgatgggcaactatttccattcgttgatgaccaccgcgccgctcacgggggcgattggctttatcattcttatgctctttctggcggtacgctggttacaacggcaacttgccgggcaagaattgctggaaacccgggctactcgtatcttaaacggtgagcgtggctctaatgttttgggaaccatctatgaatggccgcccagaaccagcagtgcgctggatacgctgcttcgtgaaattcagaacgcacgcgaacaacacagccgtcttgatacgctgatccgctcttatgccgcccaggacatgaaaaccggcctcaataaccgactcttcttcgataatcagttagcaacgttactggaagatcaggagaaagtaggtacccacgggatcgtgatgatgattcgtctgccggatttcaatatgttgagtgatacctgggggcacagccaggttgaagaacagttcttctctctgacgaatctgctatcgacatttatgatgcgctaccctggcgcactgctggcgcgttaccaccgcagtgattttgctgcgctgttaccgcaccggacgttaaaagaggcagagagcatcgccggtcagttaatcaaagccgtcgataccttgccgaacaataaaatgctcgatcgcgacgatatgatccacattggtatctgcgcctggcgtagtggtcaggataccgagcaggtaatggaacatgcagagtctgccacgcgtaatgcgggattgcagggcggcaatagctgggctatttacgatgactcgttgcctgaaaaaggacgcggtaatgttcgctggcgtacgcttatcgagcaaatgctgagtcgcggcggcccgcgcctttatcaaaaaccggcggttactcgcgaaggtcaggttcatcatcgcgaactcatgtgccgcatcttcgatggtaatgaagaggttagctcggcggagtatatgccgatggtcttgcagtttggcttatcggaagagtatgaccgcctgcaaatcagccgtcttattccactattgcgttactggcctgaggaaaatctggcgattcaggttactgttgagtcgctgattcgcccgcgttttcagcgttggctgcgagatacgttaatgcaatgtgaaagatcgcaacgaaaacgcataattattgaacttgcagaggccgatgtaggtcaacatatcagtcgcttacaacctgttattcgtttagtgaatgctttaggggtacgggtagccgtcaaccaggctggtttgacgctggtaagcaccagttggatcaaagaacttaatgttgagttactcaagctccatccggggctggtcagaaacattgagaagcgaacggagaaccagctgctggttcaaagcctggtggaagcctgctccgggaccagcacccaggtttacgccaccggcgtgcgttcgcgaagcgagtggcagaccctgattcagcgcggtgttacaggtgggcaaggggattttttcgcgtcctcacagccacttgatactaacgtgaaaaaatattcacaaagatactcggtttaacctgccgtttaatccgttttcacgtagaataacgcgcgctgcgtctcatgggagtgtgcttgtctgctcgccagattgttgcagcacatatgcagatgaatgaccttacgcggttgcaaacaggcgaggaatgctgctgatgcattaagcctttctggactcaggcagagatttgtaacaaaggaaacgaactgcactaattttcaccgtagcagatgatttttgcgccttgtcgctgctgcgtgtggttggtaaagtaagcggattttcttttccgccccagctttcaggattatcccttagtatgttgaaaaaatttcgtggcatgttttccaatgacttgtccattgacctgggtactgcgaataccctcatttatgtaaaaggacaaggcatcgtattgaatgagccttccgtggtggccattcgtcaggatcgtgccggttcaccgaaaagcgtagctgcagtaggtcatgacgcgaagcagatgctgggccgtacgccgggcaatattgctgccattcgcccaatgaaagacggcgttatcgccgacttcttcgtgactgaaaaaatgctccagcacttcatcaaacaagtgcacagcaacagctttatgcgtccaagcccgcgcgttctggtttgtgtgccggttggcgcgacccaggttgaacgccgcgcaattcgtgaatccgcgcagggcgctggtgcccgtgaagtcttcctgattgaagaacctatggctgccgcaattggtgctggcctgccggtttctgaagcgaccggttctatggtggttgatatcggtggtggtaccactgaagttgctgttatctccttgaacggcgtggtttactcctcttccgtgcgcattggtggtgaccgttttgatgaagctatcatcaactatgtgcgtcgtaattacggttctctgatcggtgaagccaccgcagaacgtatcaagcatgaaatcggttcggcttacccgggcgatgaagtccgtgaaatcgaagttcgtggccgtaacctggcagaaggtgttccacgcggttttaccctgaactccaacgaaatcctcgaagcactgcaggaaccgctgaccggtattgtgagcgcagtaatggttgcactggaacagtgtccgccggaactggcttccgacatctccgagcgcggcatggtgctcaccggtggtggcgcactgctgcgtaaccttgaccgtttgttaatggaagaaaccggcattccagtcgttgttgctgaagacccgctgacctgtgtggcgcgcggtggcggcaaagcgctggaaatgatcgacatgcacggcggcgacctgttcagcgaagagtaatcggatgcaggcaggggaaatgtctgtttaccctgcctggtctgatacgagaatacgcataacttatgaagccaatttttagccgtggcccgtcgctacagattcgccttattctggcggtgctggtggcgctcggcattattattgccgacagccgcctggggacgttcagtcaaatccgtacttatatggataccgccgtcagtcctttctactttgtttccaatgctcctcgtgaattgctggatggcgtatcgcagacgctggcctcgcgtgaccaactagaacttgaaaaccgggcgttacgtcaggaactgttgctgaaaaacagtgaactgctgatgcttggacaatacaaacaggagaacgcgcgtctgcgcgagctgctgggttccccgctgcgtcaggatgagcagaaaatggtgactcaggttatctccacggttaacgatccttatagcgatcaagttgttatcgataaaggtagcgttaatggcgtttatgaaggccagccggtcatcagcgacaaaggtgttgttggtcaggtggtggccgtcgctaaactgaccagtcgcgtgctgctgatttgtgatgcgacccacgcgctgccaatccaggtgctgcgcaacgatatccgcgtgattgcagccggtaacggttgtacggatgatttgcagcttgagcatctgccagcgaatacggatattcgtgttggtgatgtgctggtgacttccggtctgggcggtcgtttcccggaaggctatccggtcgcggttgtctcttccgtaaaactcgatacccagcgcgcttatactgtgattcaggcgcgtccgactgcagggctgcaacgtttgcgttatctgctgctgctgtggggcgcggatcgtaacggcgctaacccgatgacgccggaagaggtgcatcgtgttgctaatgaacgtctgatgcagatgatgccgcaggtattgccttcgccagacgcgatggggccaaagttacctgaaccggcaacggggatcgctcagccgactccgccgcaaagtggtgctcaaccgcctgcgcgtgcgccgggagggcaatagtggcgagctatcgtagccagggacgctgggtaatctggctctctttcctcattgcgctgttgctgcaaatcatgccctggccggataacctgattgttttccggccaaactgggtgttactcatcttgttgtattggatcctggccttgcctcatcgcgtaaatgtgggcacaggttttgtgatgggtgccatactggatctgatcagcggctcgacgcttggcgtacgcgtattggcgatgagcatcattgcttacctggtggcgctgaaatatcagcttttccgcaacctcgcattatggcagcaggcgctggtcgtcatgttgctttcgctggtggtggatattattgttttctgggcagagtttttagtgattaacgtctctttcagaccggaagtgttctggagtagtgtagtcaatggagtgctctggccgtggattttcttgctgatgcgtaaagtccgtcagcagtttgcagtgcaataaaggtttctatgacttctctgtatttagcttccggttctccgcgtcgtcaggagttacttgcgcaacttggcgtgacctttgaacgtattgttacgggcattgaggagcagcgtcagccgcaggagagcgcgcagcagtatgttgtgcgtctggcgcgcgagaaagcacaggcgggtgtcgcgcaaacggcgcaggatctcccggtgctgggtgcggacactatcgttatcctgaacggagaagtgctggagaaaccgcgcgacgcagagcatgcggtgcagatgttgcgcaaattatcgggtcagacccatcaggtaatgacggcagtggcgttggccgacagccagcacattctcgattgcctggtggtcaccgatgtgactttcagaacgttaacagacgaagacatcgcgggctatgtcgccagcggtgaaccgttagataaagcaggtgcatacggtattcaggggctgggtggctgttttgtcaggaagataaatggcagctatcacgccgtagtcggcttaccgctggttgaaacgtatgaattattaagtaattttaacgcactgcgtgagaaaagggataaacatgacggctgaattgttagtaaacgtaacgccttcggaaacgcgagtggcgtatattgatggcggtattctgcaggaaattcatattgaacgtgaggcgcgacgcggaatagtaggcaatatctacaagggtcgtgtaagtcgtgtacttccgggtatgcaggcggcttttgtagatattgggctggataaagccgcgtttcttcatgcatctgacatcatgccgcacaccgaatgtgtggcgggtgaagaacaaaagcaattcacggtgcgcgacatctcggaactggttcgtcaggggcaagatctgatggtgcaggtggtgaaagatccgcttggcactaagggggcgcgcctgaccacggatatcacgctgccttctcgctatctggtatttatgccaggggcttctcacgttggggtttcccaacgaattgaaagcgaatcagaacgtgaacgcctgaaaaaagtggtcgcagagtattgcgacgagcagggcgggtttatcatccgtaccgcagctgaaggggttggcgaggctgaactggcctccgatgccgcttatctgaaacgcgtctggaccaaagtgatggagcgtaaaaagcgcccgcagactcgttatcagctgtacggcgaactggcgctggcgcagcgtgttctgcgtgatttcgccgacgccgaactggatcgcattcgcgttgactcacgcctgacttacgaagcattacttgagttcacctcggagtacattcccgagatgaccagcaagctggagcattacaccggacgccagccgattttcgatctctttgatgtcgaaaacgaaatccagcgagcgctggaacgcaaagtagaactgaaatccggtggttatctgattatcgaccagaccgaagcgatgaccaccgtggacatcaataccggagcgtttgtcggtcatcgcaatctggacgacaccattttcaataccaatattgaagcgacgcaggctatcgctcgccagttacggttgcgcaatctgggcgggattatcattattgatttcatcgacatgaataatgaagatcaccgtcgccgcgtgttgcattcgctggagcaggcgttgagcaaagaccgggtgaaaaccagcgttaatggtttttcggcgctggggctggtggagatgacgcgtaaacgcacccgcgaaagcattgagcacgtactatgtaacgaatgcccaacctgccacggtcgcggaacggtgaaaaccgtggaaacggtatgctatgaaatcatgcgcgagattgttcgtgtacaccatgcttacgattccgaccgtttcctggtctatgcttccccggcagtagctgaagccttgaaaggcgaagagtcacactcgctggcggaagtggaaattttcgttggtaaacaggttaaagtacaaattgaaccgctctataaccaggagcagtttgacgtcgtaatgatgtaaacagatgctgggccgccatccggcaaagggtttttgagtcacatttttagcagacaaggagtgacgggtgaggcgattgccggggatattactgcttactggagccgcgctcgttgtgatcgctgccctgctggttagcggcctgcgtattgctttaccgcatcttgatgcctggcgtccggaaatcctcaacaaaatagaatccgcgactggcatgccggtagaagccagtcagctctcagccagctggcagaattttggcccgacgcttgaagcacacgacatccgtgcagaactaaaggatggcggcgaattttcggttaaacgcgttactcttgcgctagatgtctggcagagcctgttacatatgcgctggcagtttcgcgacctcactttctggcagctgcgctttcgcaccaacactcctatcaccagcggcggtggtaatgatagcctggaagccagtcacatcagcgatctgtttcttcgtcagttcgaccattttgatctccgcgacagtgaagtcagtttcctgacgccatccggtcagcgcgccgagctggcgatcccacaactcacctggctgaacgatccacgtcgacaccgtgcagaaggcctggtaagcctctccagccttaccggacagcacggcgtgatgcaggtgcgcatggatttgcgcgatgatgaggggttgttaagcaatggtcgcgtctggctccaggcggatgacatcgacctgaagccgtggctcggtaaatggatgcaggacaatattgcgctggaaacggcacagttctcccttgaaggctggatgacgatcgacaaaggcgatgtaaccggcggtgacgtctggctgaaacagggcggtgccagctggttgggcgagaagcaaacgcatacgctgtcggtggataatctgaccgcgcatattacgcgtgaaaatccgggctggcagttctctattcccgacacacggatcacgatggacggcaaaccctggccgagcggagcattgacgctggcctggataccggaacaggacgttggcggcaaagacaataaacgcagtgacgaactccggattcgcgccagtaatctggagctggcaggcctggagggcatacgcccgctggccgcgaaactttcacctgcactgggtgatgtttggcgctccacacaaccgagcggcaagattaacactctggcgctggatatcccgcttcaggcggcagacaagacccgttttcaggcatcgtggagcgatctggcctggaatcaatggaaattattaccgggtgcggaacacttctccgggacgctttccggcagcgtagaaaatggtttgcttaccgcgtcgatgaaacaggcaaagatgccttacgaaacggtattccgtgcgccactggaaatcgccgacggccaggcaacgataagctggctgaacaatgacaaaggtttccagctggatgggcgtaatattgacgttaaagccaaagccgtccatgcgcgcggcggttttcgttacctgcaaccagctaacgatgaaccctggctgggtattctggctggcatcagtaccgatgatggttcacaagcctggcgctatttcccggaaaacttgatgggtaaagacctggttgattacttaagtggcgcgattcagggcggagaagcggataacgcgacgctggtttatggtggcaatccgcaactcttcccctataaacacaacgaaggtcagtttgaagtgctggtgccgctgcgcaacgcgaagtttgccttccagccggactggcctgcattaactaaccttgatattgaactggactttatcaacgacggtttatggatgaaaaccgatggcgttaatctgggcggcgtgcgcgcgagtaatctcaccgcagtgatccctgactactcaaaagaaaaactgctgattgacactgacattaaaggcccgggtaaagccgttggcccttactttgatgagacaccgctgaaagattctctgggtgcgaccctgcaagaactccagctcgacggcgatgtgaatgctcgcttacatcttgatatcccgctgaacggcgaactggtaaccgcgaaaggtgaagtgacgctgcgtaataacagtctgtttatcaaaccactcgacagcaccctgaaaaatttgagcgggaaattcagctttattaatggcgatctgcaaagtgaaccactgacagcaagctggtttaatcagccgttgaacgtggatttttccaccaaagaaggggcaaaagcctaccaggtcgcggtgaatctcaacggtaactggcaaccagcgaaaaccggcgttctgcctgaagcggtgaacgaagcattaaatggcagcgtggcgtgggatggtaaagtgggcattgagttgccttatcatgctggcgcgacctataacgtagagctgaacggcgatctgaagaatgtgagcagtcacttaccttcaccgttagccaaacctgcgggtgaaccactaccggtaaacgttaaggttgatggcaatctcaacagctttgagttaaccggacaggctggtgcagataaccatttcaatagccgctggttgcttggtcaaaagctgacgctcgaccgtgctatttgggcggcagacagtaaaacgctcccgccgttgccggaacaaagtggcgttgaactcaatatgccgccgatgaatggtgccgagtggctggccctgttccagaaaggcgcggcggagagtgtcggtggtgcagcgagtttcccacaacacataacgttacgtacgcctatgttgtcgctgggaaatcagcaatggaataacctgagtattgtttcgcaaccgacggcaaatggcaccctggttgaggcgcaagggcgtgaaatcaacgccacgctggcgatgcgtaataacgcgccgtggctggcgaatatcaaatatctttattacaacccgagcgtggcgaaaactcgtggtgattcaacacagtcatcacctttcccgacaacggagcgcattaacttccgtggctggccggacgcccaaatacgatgcgcagagtgctggttctgggggcaaaaattcgggcgcattgacagtgatatcaccatttctggcaatacattaacgctgaccaatggactgattgatactggtttctcgcggcttactgccgatggtgaatgggttaacaatccgggaaatgaacgcacctcgctgaaaggaaaactgcgtgggcagaaaattgatgccgccgcagaattttttggtgtcacgacgcccatacgccagtcgtcatttaatgtggattacgatttacactggcgcaaagcaccctggcaaccagatgaggcgacgttgaatggcatcattcatactcaactgggcaaaggcgaaattaccgaaatcaataccggacatgccgggcaattgctgcgcttattgagcgttgatgccctgatgcgtaagctgcgttttgatttcagagacacctttggtgaagggttctattttgactccattcgcagcaccgcgtggattaaagacggcgttatgcacaccgacgacacgctggtggatggcctggaagcggacattgccatgaaagggtcggtaaatctggtgcgtcgcgacctgaatatggaagcggttgtcgcaccagagatttctgcgacggtgggcgtggctgcggcttttgcggttaaccccattgttggcgcggcagtgtttgcagccagtaaagtgctggggccgctgtggagcaaagtctccattttgcgctatcacatttcgggtccgctggacgatccgcaaatcaacgaagtgttgcgccaaccgcgtaaagaaaaagcgcaatgatttgacgagggcgcgtaattgccccaatctcatatgataatcgttgccaaaggccaacgagccggaacataaccgtaggccggatagggcgttcacgccgcatccggcagccgtaaaaaatcctctactgcagtaactaacgagtagcaaaaacgatgagtctgaacctggtaagtgaacaattgctagcggcgaacggcctgaaacatcaggacttgttcgcgatcctcggtcaactggccgaacgtcgccttgattatggcgatctctattttcagtcgagctatcacgaatcctgggttttagaagaccgcattattaaagatggttcttacaacatcgatcagggtgttggtgtgcgtgcaatcagcggtgaaaaaaccggatttgcttacgcagaccaaatcagcctgctggcgctggaacagagtgcgcaagcggcgcgcaccatcgtccgtgatagtggtgatggcaaagtacagacgctgggcgcggtagagcatagcccgttgtatacctcggtagatccgctgcaaagcatgagccgtgaagagaagctggatatcctgcgtcgcgtcgataaggttgcccgcgaagcggacaagcgcgtacaagaagtgactgccagcctcagcggcgtttatgaattaattctggttgcggccaccgacggcacgctggcggcggatgttcgtccgctggtgcgtctttccgtgagcgttctggtcgaagaagatggcaaacgcgaacgcggtgccagtggcggcggcggtcgttttggttatgagttcttccttgccgatctcgacggtgaagtccgtgcggatgcatgggcaaaagaagcagtgcgtatggcgctggtcaatctttctgccgttgctgcaccagcgggcaccatgccggtagtacttggcgcaggttggccgggcgtgctgttgcatgaagcggtaggtcacggtctggaaggcgacttcaaccgccgtggcacttcagtatttagtggacaggtcggggagctggtggcttcagaactgtgtaccgtggttgatgacggtacgatggtcgatcgccgtggttcggtggcgattgatgacgaaggtacgccaggccagtacaacgtgctgattgagaacggcatcctgaaaggctacatgcaggataaactcaacgcgcgtttgatggggatgacgccgactggcaacggtcgccgtgaatcctacgctcatctgccgatgccgcgtatgaccaacacctatatgctgccgggtaaatcgaccccgcaagaaattattgaatccgttgagtacggtatctatgcaccgaactttggtggcggtcaggtggatattacatccggcaaattcgttttctccacttcagaagcgtatctgattgaaaacggtaaagtaacgaagccggtgaaaggcgcgacgttgattggttccggtatcgaaaccatgcagcagatttcgatggttggcaacgacctgaaactggataacggcgtgggtgtctgcggtaaagaagggcaaagtttgccggttggcgtgggccagccaacgctgaaagttgataacctgactgttggcggtaccgcgtaataatttcagtattttcagaaggataattaatccttttacgtgcacgaacggtcccctcgcccctctgggattagggtgaggggaacccgttggcacaggtttgtacaacgtaacagtataatattaattacttctctttcccgcgcccgtgcatctcctgaaacaatttaccgacctcaacaaaataatccgttagcgagttgatcacgacttgtaccttcagcggcagcttatctttttcggtatataacgcataaaccgggcgtggatctgactggtaacgtggcagcaggatctccagctccccgcgattgatctcgttgatcacccacatcagcggcacataggcgatcccagcgcctgcagtcagccagcgcaccagcgtcatcggatcattagtcacaaatctcccttgcgggatcaggcgagtcgagatcccttccggtgcgatcagttcaaattcattgtcgggtcgcacgctgtattcaagccatgaatgactacttaaatcggcgggtttttccggtatgccgtattgtgtgagatagcttttcgcggcgcacaccaccattggcatcgcgcccagacggcgggaaaacaggctggaatcctgcaacgcgccgacgcggatcaccacatccagaccgtcggcaatcaggtcgggggcaggaattccggtaaccagattgacgctcaaacctgggtattctttcagcatttttgctgtcagcccggcgagaacattttgtgccatagttgaagaacagccaatgcgcagcgtcccgatgggggtgttattgaaggcatacagttgctcatgaacatcctgcacttcatggagcatccgacggcagccctggtagtaaattctgccggcttcggtcaggccaatgctgcgtgtgctacggtttaacagctttacctgcaactcatcttccagttttgacaccgtctgactgatggacgaaacgctcatctgtagctgtctggcggcggcggtaaaagagccaaattcaactactttggcaaacaccgacatgcgttttagtcgttccattattcactctgacttaaaagtgatttagatcacataatatagataacagcataacagttacgctaatatattaaatatcaatctacagcaatgttgctctcgcccggctttccatgcccttctctgcggcgacagatgctgaaaataataacgcctgctctctctatacaaccaaggtcaacatgagtctgtttcccgttatcgtggtgtttgggctgtccttcccaccgatattttttgaattgcttttatcactggcgattttctggctggtgcgccgggtacttgtgccaacaggtatctacgactttgtctggcatccggcgttgttcaacaccgcgctctattgctgcttgttttatttgatatcgcgactgttcgtttgaggttgaagtgaaaacactaataagaaaattctcccgtacggccatcacggtcgtattagtcattctggccttcatcgcaatttttaatgcctgggtctattacaccgaatccccgtggacgcgtgacgcgcgctttagcgctgacgtcgttgcgatcgcgccggacgtttctggacttatcacccaggtgaatgttcatgataaccagctggtgaaaaaaggacaggtactgttcaccatcgaccagccgcgctatcaaaaggcgcttgaggaagcgcaagccgatgttgcttattatcaggtactggcacaggagaaacgccaggaggccggacgtcgtaaccgtctcggtgtgcaggcgatgtctcgcgaagagatcgatcaggccaacaacgtactacaaacggttctgcatcagttagcgaaagcgcaggcgacccgcgatctggcaaaactggatcttgaacgcacggtgatccgcgcgccagcagatggctgggtgaccaacctcaacgtctataccggtgagtttattacccgtggatcaacggcggttgcgctggtgaaacagaactccttctatgtactggcctatatggaagaaactaagctggaaggggtgcgccctgggtatcgtgcagagatcacgccgcttggcagtaacaaagtgctgaaagggactgttgatagtgttgccgctggggtcaccaacgccagcagcacgagtgacgacaaagggatggcgaccatcgactctaaccttgaatgggtgcgtttggcgcaacgtgttccggttcgtattcgtctcgacaaccagcaagagaacatctggcctgcgggcaccactgctacagtggtggtcactggcaaacaagatcgcgacgaaagccaggattcgttcttccgtaaaatggcccatcgcctgcgtgagtttggttaatcacgatgggtattttctccattgctaaccaacatattcgctttgcggtaaaactggcgaccgccattgtactggcgctgtttgttggctttcacttccagctggaaacgccacgctgggcagtactgacagcggcgattgttgccgccggtccggcctttgctgcgggaggtgaaccgtattctggcgctattcgctatcgtggctttttgcgcatcatcggcacatttattggctgtattgccggactggtgatcatcattgcgatgatccgcgcaccattattgatgattctggtgtgctgtatctgggccggtttttgtacctggatatcctcgctggtacgaatagaaaactcgtatgcgtgggggctggccggttataccgcgctgatcattgtgatcaccattcagccggaaccattgcttacgccgcagtttgccgtcgaacgttgtagcgagatcgttatcggtattgtgtgtgcaattatggcggatttgctcttttctccgcgatcgatcaaacaagaagtggatcgagagctggaaagtttgctggtcgcgcaatatcaattaatgcaactctgtatcaagcatggcgatggtgaagttgtcgataaagcctggggcgatctggtgcgacgcaccacggcgttacaaggtatgcgcagcaacctgaatatggaatcttcccgctgggcgcgggccaatcgacgtttaaaagcaatcaatacgctatcgctgacgctgattacccaatcctgcgaaacttatcttattcagaatacgcgcccggaattgatcactgatactttccgcgaattttttgacacgccggtagaaaccgcgcaggacgtccacaagcagctcaaacgcctacggagagttatcgcctggaccggggaacgggaaacgcctgtcaccatttatagctgggtcgcggcggcaacgcgttatcagcttctcaagcgcggcgttatcagtaacacaaaaatcaacgccaccgaagaagagatcctgcaaggcgaaccggaagtcaaagtagagtcagccgaacgtcatcatgcgatggttaacttctggcgaaccacactttcctgcattctggggacgcttttctggctgtggacgggctggacttcaggcagtggtgcaatggtgatgattgcggtagtgacgtcactggcaatgcgtttgccgaatccacgcatggtggcgatcgactttatctatgggacgctggcggcgctgccgttagggctgctctactttttggtgattatccctaatacccaacaaagcatgttattgctgtgtattagcctggcagtgctgggatttttcctcggtatagaagtacagaaacggcgactgggctcgatgggggcgctggccagcaccataaatattatcgtgctggataatccgatgactttccatttcagtcagtttctcgacagcgcattagggcaaatcgtcggctgtgtgctcgcgttcaccgttattttgctggtgcgggataaatcgcgcgacaggactggacgtgtactgcttaatcagtttgtttctgctgctgtttccgcgatgactaccaatgtggcacgtcgtaaagagaaccacctcccggcactttatcagcagctgtttttgctgatgaataagttcccaggggatttgccgaaatttcgcctggcgctgacgatgattatcgcgcaccagcgcctgcgtgatgcgccgatcccggttaacgaggatttatcggcgtttcaccgacaaatgcgccgcacagcagaccatgtgatatctgcccgtagcgatgataaacgtcgtcggtactttggccagttgctggaagaacttgaaatctaccaggaaaagctacgcatctggcaagcgccaccacaggtgacggaaccggttcatcggctggcggggatgctccataagtatcaacatgcgttgaccgatagttaagtcaaaaccgacgccaaaagcgtcggttttttcatggctatacttagcgatgaacggcagaactcgccgcgaaacgtgacggtggcaacagatgaatatttatacctttgattttgatgagattgagagtcaggaggatttttatcgcgacttcagccaagcctttggtctggcgaaagataaggtacgcgatctcgactcattatgggatgtgttaatgaacgatgtcctgccgctaccacttgagattgaatttgttcatctgggagagaaaacgcgtcgccgttttggcgcgttaatattgctgtttgatgaggcagaggaagagttggaagggcatttgcgttttaatgttcgtcattagcgcaaaaaaaagcccccgaaccgggggcaatatcgtcggacaagacgatgagggtttatttgtacagttcagccgtagcgtgccaggtgtcaccgctacgagcttccgtaatctggtaggccgttgcgcctttctcttctgcttttttgttcagcatttcacgcatatccattggcgaagacgccacaccacttacggatacggtcccgattgcttcacgattttgtgcttgtgcagcatcaatggagtcggcagcgaatgcaccgaaagatagaacagaaagtacgcttaatgcagcaacagtggttttgattttcatgatttttacctcgacataatcttttagctgggcctttgtttcgtgacccatatcacaaaatcaagtatacactaattattgaactaattaataccacgctaactgtttcagttgatactaagtgttaaaaatgtgagttttaataacaaaaaagaattaaaaacacggttatttattattaattctattgttttcaattagataatgaattttgcataatgtgctttttttaccgtatgtattcattgtgtgaatgacatgtcgcagtaaaacgcactattcgttaaattaatcgcagaggaaagcagggggttgagagggataagcaacattttccccgccgccagaagcgacggggcagagattaaagctcctggtcgaacagctctaaaatcgcttcgtacaggtctttgacggtgaaaccgttagcaggggtagtaaagatggtgtcatcgccagcgatggtgcccagaataccttctgctttgcccagtgagtccagcaggcgagcaattaactgcgccgcgccagggctggtatgaatcacgacaactgcatcgttgtagtcgatatccagcaccagatttttcaatggactggaggtggttggtacacccagttcagctggcaggcagtaaaccatttccattttggcattgcgtgtacgtacagcaccaaacttggtcaacatccgcgagactttagactgattaatattgtcaaagccttgctcctgcaacgcggcgacgatttcgccctgggagctaaatttctcttctttaagtaatgctttaaatgctttaactagttcttcttgcttagccgagcttcgcataagtcacccgatatggtggttgatacaacattattgtgcatacagatgaatttttatgcaaacagtcagccctgaagaaggctgaaataatgttatgaaagagcgggattttatcaaatttcgttattgagaaacatgcctgcgtcacggcatgcaaattctgcttaaaagtaaattaattgttatcaaattgatgttgttttggctgaacggtagggtatattgtcaccacctgttggaatgttgcgctaatgcataagcgactgttaattacgtaagttaggttcctgattacggcaattaaatgcataaacgctaaacttgcgtgactacacattcttgagatgtggtcattgtaaacggcaattttgtggattaaggtcgcggcagcggagcaacatatcttagtttatcaatataataaggagtttaggatgaaagtcgcagtcctcggcgctgctggcggtattggccaggcgcttgcactactgttaaaaacccaactgccttcaggttcagaactctctctgtatgatatcgctccagtgactcccggtgtggctgtcgatctgagccatatccctactgctgtgaaaatcaaaggtttttctggtgaagatgcgactccggcgctggaaggcgcaaatgtcgttcttatctctgcaggtgtagcgcgtaaaccgggtatggatcgttccgacctgtttaacgttaacgccggcatcgtgaaaaacctggtacagcaagttgcgaaaacctgcccgaaagcgtgcattggtattatcactaacccggttaacaccacagttgcgattgctgctgaagtgctgaaaaaagccggtgtttatgacaaaaacaaactgttcggcgttaccacgctggatatcattcgttccaacacctttgttgcggaactgaaaggcaaacagccaggcgaagttgaagtgccggttattggcggtcactctggtgttaccattctgccgctgctgtcacaggttcctggcgttagctttaccgagcaggaagtggctgatctgaccaaacgtatccagaacgcgggtactgaggtggttgaagcgaaagccggtggcgggtctgcaaccctgtctatgggccaggcagctgcacgttttggtctgtctctggtacgcgcactgcagggcgaacaaggcgttgtcgaatgtgcctacgttgaaggcgacggtcagtacgcccgtttcttctctcaaccgctgctgctgggtaaaaacggcgtggaagagcgtaaatctatcggcactctgagcgcatttgaaaagaacgcgctggaaggtatgctggatacgctgaagaaagatatcgctctgggcgaagagttcgttaataagtaattgattagcggataataaaaaaccggagcgcagactccggttttttgttttgagcgcacgacttaattggttgccggatattcctgaatggtgacctgcagcgttaactgcttatcatcacgcatcacgacaaccgggatcaccgaaccagggcgaatttccgccacctgatccatcgtctccagagcagagatggccggtttgttatccaccgaaataatcaaatcattgacctgaatacccgcattcgccgccgggccgtcaggtgacacttcattaaccacgatcccttgcagttgatctataccaccgccctgcgcgtgcagtggtgcgatctcacgtccgccgataccaatgtagccgcggatcacgcgaccatcgcggatcagtttatccataattttggttgctaactggaaaggaatcgcaaagccgataccttccggcgtttcgccatcgttactcttatcaaacgacagcgtgttaatgcccatcagttcgcccagcgagttcaccagcgcgccgccagagttaccgtggttaatggaagcatcagtttgcaggaagttttgccgcccggttgggttcagaccaattcgacccgtggcactaataatcccctgggtaatggtctgcccgaggttgtacgggttaccgatcgccagtaccacgtcgccaatgtgcggtacgcgacgtgcattgattggaatagtaggtaaaccgccagtggcattaattttaagtaccgccagatcggttagagagtcagatcccaccagcaatgcttcaaatacacgtccatcctgtaaggcgacgatgatctgatcggcgtcgttgatgacgtgtttattggtgatgatataaccgcgttgatccatgattacaccggatcccagggtgcggatctcaagctggttgtgagagttggtgttcaaacctcggttgtaaacgttaaccaccgctggcgcggcgcggcgaaccgccagattatagctggcaggcgtctcatcggtactgtcaaattgcggagtggaaagcgggttaaggctgcgcagcgaaggcatggcaaccagcagaatagcgccgacaattaatccaatcgcaacggaacgtaagagcttcacaaacatgatggaggcgtcattaaaaaagggaacggcagcagcataccacgagttaaccggacatcacacgtcagcctgatgcccggtttacgacattaacgcatcagcagatagatgctttcattgccgcgtacaatttgcagggcgataatggccggttttgccgccagcactttacgcatttcagcaatcgagttcacccgatcgcggttgacgccaatgatcacatcgtctttttgcaagccagcctgagcagctgggcttcctttgacaacctcatcgatcttaatacctttgccgccatcttttagctgaccatcgctcaacgttgcaccttcaagcgctggcgtgatcatttcagcgctggccgacgaagaggtgctggtatcgagcgtcacttctacttccagtggtttgccgttacgcagcaggccaagcttcactttcgtgcccggctcggtggttgcgatacgagagcgcaactcagcaaagctattcagcggtttgccgttgaggctggtaataatatcgcccgctttgacgcccgcttttgccgagccagaacctggcaacacttcgctgacaaacgcgccacgctgcacgtcaaggttgaaggctttggcgatatcggcactcatctctgtgcctttgatgcctaacagaccgcgtttgatttcaccaaagtcgataagctgctgcgccagtgttcgcgccatattactggggatggcaaatccaatcccgacgctcccgccaccaggcgcaaggattgccgtgttgatgccaattaactcaccgttaagatttaacagtgcaccgccggagttaccgcggttaatggaagcatctgtctggataaagttttccagaccttcaagattcaacccactgcggcctaatgctgacacaatgccagaggtggcggtttgcccaaggccaaatgggttaccgaccgccacggcaaaatcaccgacgcgcaatttatcggagtcggcaatagcgatttgcgttaatttgctcgggttttgaatttgcaacagggcgatatcgctctggtcatcgctaccaatcagttttgcatcaaactcgcgcccatcattgagctgaatactgattttctgtgcctgattaatcacatggttgttggtcagcacatagcctttactggcgttgatgatgacaccggagcctaaaccttcgaagggttgtgcaggttgatccggtaaatcatcaccaaaaaactttttgaattcttccgggattttctgtccctgactggccgttccttccacccgtacgctcaccactgccggaagcactttttccagcattggggccagactggggaggggggcctgatcggcaacctggcctggaatcgacgcaacggcctgaaatgacgccgagagagttaacccgacacttaacgctaatgcactcaacagctgggtttgttttttcattattcctgctctcgtacctgaatgataagaaaagagattcaaaacagtttgatgttattgaattttcagacggctaacaatgagacaccagattaaatgatagtcggggagggagagaagaggagggcgcaatggctgcgcccgaaaaataaattagtcgcgcttcgcgccagtacgcagcaggccggacgcgccttcagaatagtcgcgaggcatctgcaccggtgcctgatcgttgctggcttcagactctgccagacgattacggaacgggtttgcttcagcagacagttccggcagcaggctgctggagcttttcgccatgtgctgatacagctggcgatagtcgtgcgccatggtatccagtaattccgcgctgcgggcaaagtggctaaccagctcttcgcgatactcgtccagttcagctttattcttttccagttcgtactgcaacgcctgttgctggcgtagtttacgattaccaaaacgcatggccacagcaccaataatgatgccgacgactaacccaattagcgcatattcccaggtcatgaacatctcccgttgtcttttgtttccgtagggtgttggcttcaggctccatgcctgcggctgattatgccactataaccgttaattccacagaagtggaatcccgactgcatatcgcgtagtgtagaacggcctttttttcgtcaaccgtgaacaacggcgcaccgattattcaaggaataacaataagatcatgcaaagcgttaccccaacatcgcaatacctgaaggcgctcaatgaaggcagccatcaacccgacgacgttcaaaaagaggccgtcagccgcctggaaattatttatcaggaactcatcaatagcacgcctccagcccccaggacgagtgggctaatggcgcgggtcggtaagctgtggggtaaacgcgaagacacaaagcatacgccagtgcgtggcttatatatgtggggcggtgtaggacgcgggaaaacctggctgatggaccttttctatcaaagcctgccgggagagcggaaacagcgtctgcactttcaccgttttatgctgcgggtgcacgaagagctgaccgaattacaaggccaaagcgatccgctggaaattattgccgatcgctttaaagcagaaactgacgtgctctgttttgacgaattttttgtttctgatattaccgatgccatgctacttggcggtctgatgaaagccctgttcgcccgcggtattaccctggtagcgacgtcaaatattccgccggacgaactttatcgaaatggcctacaacgtgcgcgttttttgcctgcaatcgatgccattaaacagcattgtgatgtaatgaacgtggacgctggtgttgattatcgactgcgtacactcactcaggcgcatctgtggctttcgcccctcaacgatgaaacccgggcgcaaatggataaactatggttggcgctggcgggggcgaaacgagaaaattcaccgacgttagaaatcaaccatcggccattggcgacaatgggcgtcgagaaccagacgctggcggtctcttttactacgctgtgcgtcgacgcccgcagtcagcatgactatattgcgctctcacgcctctttcacacggtcatgttgtttgatgtgccagttatgacgcggttgatggagagcgaagcgcggcgctttattgcgctggtggatgagttttacgagcgccatgtcaaattagtggtgagtgcagaagtgccgctatatgacatttatcagggcgagcggctgaaatttgagttccagcgttgcctgtcacgtctgcaagagatgcaaagcgaagagtatctgaagcgcgagcatttagcgggttaaaacctgccacaaatcacaaaaaggggtcgatctttgaccccgacttctctataatcctgcgaccccacgttacaagaaagtttttttcccaaaactttttgtgtgctggcataggctattcgaaggggtaggtttgccggactttgtcgtgtgaacctcaacaattgaagacgtttgggtgttcaccaacgtgtaactatttattgggtaagcttttaatgaaaacttttacagctaaaccagaaaccgtaaaacgcgactggtatgttgttgacgcgaccggtaaaactctgggccgtctggctactgaactggctcgtcgcctgcgcggtaagcacaaagcggaatacactccgcacgtagataccggtgattacatcatcgttctgaacgctgacaaagttgctgtaaccggcaacaagcgtactgacaaagtgtactatcaccacaccggccacatcggtggtatcaaacaagcgacctttgaagagatgattgctcgccgtcctgagcgtgtgattgaaatcgcggttaaaggcatgttgccaaaaggcccgctgggtcgtgctatgttccgtaaactgaaagtttacgcgggtaacgagcacaaccacgcggcacagcaaccgcaagttcttgacatctaatcgggattataggcaatggctgaaaatcaatactacggcactggtcgccgcaaaagttccgcagctcgcgttttcatcaaaccgggcaacggtaaaatcgtaatcaaccaacgttctctggaacagtacttcggtcgtgaaactgcccgcatggtagttcgtcagccgctggaactggtcgacatggttgagaaactggacctgtacatcaccgttaaaggtggtggtatctctggtcaggctggtgcgatccgtcacggtatcacccgcgctctgatggaatacgacgagtccctgcgttctgaactgcgtaaagctggcttcgttactcgtgacgctcgtcaggttgaacgtaagaaagtcggtctgcgtaaagcacgtcgtcgtccgcagttctccaaacgttaattggcttctgctccggcagaaaacaatttgcgaaaaaacccgcttcggcgggtttttttatggctaaattctgaatcagcgtaaaaaatggaaagttgctttttgctgccgtctgacagacaggcaaaacaaaaaccacatcgccaataagggactaagtcaactatttcagactaaagcgcatctctttttccccatttccggcatcgactcaccacaaaggtcgcaaaatctggtaaactatcatccaattttctgcccaaatgtcgggtattgctcattttttgtttgattttcgaacaaagagagtcgttccttactgggtaacacaacttctgactggccacctggtggctggtagcagtaaaaattctgactatacctggaggttttcatggctgtcgctgccaacaaacgttcggtaatgacgctgttttccggtcctactgacatctatagccatcaggtccgcattgtgctggctgagaaaggtgtaagtttcgagatcgaacacgtggaaaaggacaatccgcctcaggatctgattgacctcaacccgaatcagagcgttccgaccctggtggatcgtgagctgaccctgtgggaatctcgcatcattatggaatatctggatgagcgtttcccgcatccgccactgatgcctgtttacccggtagctcgcggtgaaagccgtctgtacatgcatcgcatcgaaaaagactggtacacgctgatgaacaccatcatcaacggttcagcttctgaagcagatgccgcacgtaagcaactgcgcgaagaactgctggcgattgcgccggtcttcggtcagaagccgtacttcctgagcgatgagttcagcctggtcgattgctaccttgctccgctgctgtggcgtctgccgcaactgggtatcgagttcagcggcccgggtgcgaaagagctgaaaggctatatgacccgcgtctttgagcgtgactctttccttgcttctttaactgaagctgaacgtgaaatgcgtctgggccggagttaatctgtatggatttgtcacagctaacaccacgtcgtccctatctgctgcgtgcattctatgagtggttgctggataaccagctcacgccgcacctggtggtggatgtgacgctccctggcgtgcaggttcctatggaatatgcgcgtgacgggcaaatcgtactcaacattgcgccgcgtgctgtcggcaatctggaactggcgaatgatgaggtgcgctttaacgcgcgctttggtggcattccgcgtcaggtttctgtgccgctggctgccgtgctggctatctacgcccgtgaaaatggcgcaggcacgatgtttgaacctgaagctgcctacgatgaagatgccagcatcatgaatgatgaagaggcatcggcagacaacgaaaccgttatgtcggttattgatggcgacaagccagatcacgatgatgacactcatcctgacgatgaaccaccgcagccaccacgtggtggtcgaccagcattacgcgttgtgaagtaatactaaaacaggccctggcggcctgttttgtctttttaatgacttaataaaatagcgtgattgtggcaatcatattcaccacgaaaccgactgccatggggatcgctgtccgcttcactaccgcaaaaggcgaaacgcctgcaattcctgacgtaacgaccaccaccgcagtaatcggcgaaacagcgcgcgctagcgtcgtggcaaaatgcatcggcataatcattacaaccgctggcacatgtagtccggctgcgatattcggaataagactggcaaatgacataaacggcgcattgcctgagcccatcacaatggcacaaatggcaatgaccagcgccataataatcatcacgccaataccgcccagaccagaatgctccgcacccctgataaccgcatcgacagtgccaatcgtcgttaagcctttcgcaaatatttcacccgcgaccaccagcgttaccacgttggcaaactgcgtacccatgccgtcaaaaaacgcctgcacatcatccattgtttcgcgcaagttatgcttgcggaagaactcaacaaacatcgtcaccgtcaaactcagtaacatcaccaccaccagatgcagttctgactgcatcagcccgacgtgggcaaggaacagcgagccgagcatcaggattaacggcatcaccggtaaaatggcgtaatagagcggcgggacattatcgagagctttttgctctgcctgttcgtgattgatatttttatcttttttgtcgaaagcgcgttgcacgaaaaagtgggagatcgccaccgagataatgacgcaagaggcgaccggaagctggtagtggaagaagtaagtggcaattttcattcctgcgacctgggcagcaaaaatggagttcgtttccagaatcccccactcaatggacatggtggttgcgataaccgccaccgcagagagacgacttactcccagactcaccagcgtcggaaataaggtgaccatcagcaacatacccagaccggaggcgctggtaataaactgcgccatgatttggccgatgacgtaagttgccgacagaataatatacggcgagcgaatgagttttaacgggcggcttaacaagctcaccatcgcgcgacttgcccctatgcgctccatatagcgggcataaccgcccactgccataatcgacagccccaatccagcaatgcggttggacagcatgcgcaggatttcattataaatatcgacgatcaagtagccgctgcttttggcgggatcgagcacaccaccgaaccctaaccagacaccgcacatcatcaggaagatacctgcggcagccagcaccacctgaggtttgtagtttttcaggatcaaatagcccatcgtaattaatacgatgacagatataattatgccgaacattgttgaactccgtgtcaaaagaaaacggtcaatcccataaacggcagattgaaaacaatgatgttatattttttgcaaggttatttatggtgcggatgtcgtgtttttaattgtaggtgaggtgatttttcattaaaaaatatgcgcttatgattattttgtaagaacacattcataatattcataatgctcgtgaatagtcttataaataattcaatcgggatgtttttatctgcgttacattaatttttcgcaatagttaattattccgttaattatggtaatgatgaggcacaaagagaaaaccctgccattttcccctactttcaatcctgtgataggatgtcactgatgatgttaatcacactgaccttacagaatgggccttatgaacgcatttgattcgcaaaccgaagattcttcacctgcaattggtcgcaacttgcgtagccgcccgctggcgcgtaaaaaactctccgaaatggtggaagaagagctggaacagatgatccgccgtcgtgaatttggcgaaggtgaacaattaccgtctgaacgcgaactgatggcgttctttaatgtcgggcgtccttcggtgcgtgaagcgctggcagcgttaaaacgtaaaggtctggtgcaaataaacaacggcgaacgcgctcgcgtctcacgtccttctgcggacaccatcatcggcgagctttccggcatggcgaaagatttcctttctcatcctggtgggattgcccatttcgaacaattacgtctgttctttgaatccagcctggtgcgctatgcggctgaacacgccaccgatgagcaaatcgatttgctggcaaaagcactggaaatcaacagtcagtcgctggataacaacgcggcattcattcgttcagacgttgatttccaccgcgtgctggcggagatccccggtaacccaatcttcatggcgatccacgttgccttgctcgactggctgatcgccgcacgtccaaccgtggctgatcaggctctgcacgagcataacaacgttagctatcaacagcatattgcgatcgttgacgcgatccgccgccatgatcccgatgaagccgatcgcgcgttgcaatcgcatctcaacagcgtctctgctacctggcatgccttcggtcagagcaccaacaaaaagaaataatgccactttagtgaagcagatcgcattataagctttctgtatggggtgttgcttaattgatctggtataacaggtataaaggtatatcgttttatcagacaagcatcacttcagaggtatttatggcaacgaatttacgtggcgtaatggccgcactcctgactccttttgatcaacaacaagcactggataaagcgagtctgcgtcgcctggttcagttcaatattcagcagggcatcgacggtttatacgtgggtggttctaccggcgaagcctttgtacaaagcctttccgagcgtgaacaggtactggaaatcgtcgccgaagaggcgaaaggcaagattaaactcatcgctcacgtcggttgcgtcagcactgctgaaagccaacaacttgcggcatcggctaaacgttatggcttcgatgccgtctccgccgtcacgccgttctactatcctttcagctttgaagaacactgcgatcactatcgggcaattattgattcggcggatggtttgccgatggtggtgtacaacattcctgccctgagcggggtaaaactaaccctggatcagatcaacaccctggttacgctgcctggtgtcggcgcgctgaaacagacctctggcgatctctatcagatggaacagatccgtcgtgaacatcctgatctggtgctctataacggttacgacgaaatcttcgcctctggtcttctggcgggcgctgatggtggtatcggtagtacctacaacatcatgggctggcgttatcaggggattgtgaaggcgctgaaagaaggcgatatccagaccgcgcagaagctgcaaaccgaatgtaataaagtcattgatttactgatcaaaacgggcgtattccgcggcctgaaaacggtcctgcattatatggatgtcgtttctgtgccgctgtgccgcaaaccgtttggaccggtagatgaaaaatatctgccagaactgaaggcgctggcccagcagttgatgcaagagcgcgggtgagttgtttcccctcgctcgcccctaccgggtgaggggaaataaacgcatctgtaccctacaattttcataccaaagcgtgtgggcatcgcccaccgcgggagactcacaatgagtactacaacccagaatatcccgtggtatcgccatctcaatcgtgcacaatggcgggcattttccgctgcctggttgggatatctgcttgacggttttgatttcgttttaatcgccctggtactcaccgaagtacaaggtgaattcgggctgacgacggtgcaggcggcaagtctgatctccgcagcctttatctctcgctggttcggcggcctgatgctcggcgctatgggtgaccgctacgggcgtcgtctggcaatggtcaccagcatcgttctcttctcggccgggacgctggcctgcggctttgcgccaggctacatcaccatgtttatcgctcgtctggtcatcggcatggggatggcgggtgaatacggttccagcgccacctatgtcattgaaagctggccaaaacatctgcgtaataaagccagtggttttctgatttccggcttctctgtgggggccgtcgttgccgctcaggtctatagcctggtggttccggtctggggctggcgtgcgctgttctttatcggcattttgccaatcatctttgctctctggctgcgtaaaaacatcccggaagcggaagactggaaagagaaacatgctggtaaagcaccagtacgcacgatggtagatattctctaccgtggtgaacatcgcattgccaatatcgtaatgacactggcggcggctactgcgctgtggttttgcttcgccggtaacctgcaaaatgccgcgatcgtcgctgttcttgggctgttatgcgccgcaatctttatcagctttatggtgcaaagtacgggcaaacgctggccaacgggcgtaatgctgatggtggtcgtgttgtttgctttcctctactcatggccgattcaggcgctgctgccaacgtatctgaaaaccgatctggcttataacccgcatactgtcgccaatgtgctgttctttagtggctttggcgcggcggtgggatgctgcgtaggtggcttcctcggtgactggctgggaacccgcaaagcgtacgtttgtagcctgctggcctcgcagctgctgattattccggtatttgcgattggcggcgcaaacgtctgggtgctcggtctgttactgttcttccagcaaatgcttggacaagggatcgccgggatcttaccgaaactgattggcggttatttcgataccgaccagcgtgcagcgggcctgggctttacctacaacgtcggcgcattgggcggtgcactggccccaatcatcggcgcgttgatcgctcaacgtctggatctgggtactgcgctggcatcgctctcgttcagtctgacatttgtggtgatcctgctgattggtctggatatgccttcccgcgttcagcgttggttgcgcccggaagcattgcgtactcatgacgctatcgacggcaaaccatttagcggtgccgtgccatttggccgcgccaaaaacgatttagtcaaaaccaaaagttaatcctgttgcccggtctctgtaccgggcctttcgctaagggaagatgtatgtcgttacttgcacaactggatcaaaaaatcgctgctaacggtggcctgattgtctcctgccagccggttccggacagcccgctcgataaacccgaaatcgtcgccgccatggcattagcggcagagcaggcgggcgcggttgccattcgcattgaaggtgtggcaaatctgcaagccacgcgtgcggtggtgagcgtgccaattatcgggattgtgaaacgcgatctggaggattctccggtacgcatcacggcctatattgaagatgttgatgcgctggcgcaggcgggcgcggacattatcgccattgacggcaccgaccgcccgcgtccggtgcctgttgaaacgttgctggcacgtattcaccatcacggtttactggcgatgaccgactgctcaacgccggaagacggcctggcatgccaaaagctgggagccgaaattattggcactacgctttctggctataccacgcctgaaacgccagaagagccggatctggcgctggtgaaaacgttgagcgacgccggatgtcgggtgattgccgaagggcgttacaacacgcctgctcaggcggcagatgcgatgcgccacggcgcgtgggcggtgacggtcggttctgccattacgcgtcttgaacacatttgtcagtggtacaacacagcgatgaaaaaggcggtgctatgaccacactggcgattgatatcggcggtactaaacttgccgccgcgctgattggcgctgacgggcagatccgcgatcgtcgtgaacttcctacgccagccagccagacaccagaagccttgcgtgatgccttatccgcattagtctctccgttgcaagttcatgcgcagcgggttgctatcgcttcaaccggaattattcgcgacggcagcttaatggcgctaaatccgcataatctcggtggattactacactttccgttagttaaaacactggggcagcttaccgatttgccgaccattgccattaacgacgcgcaggccgcagcatgggcggagtatcaggcgctggaaggcgatataaccgagatggtgtttatcaccgtttccactggcgtcggcggcggtgtagtgagcggcggcaaactgcttaccggccctggaggtctggcggggcacatcgggcatacgcttgccgatccgcatggtccagtctgcggctgtggacgcacaggttgcgtggaagcgattgcttctggtcgcggtattgcagcggcagcgcagggtgaactggcgggcgcggatgcgagaactatttttacacgcgccgggcagggcgacgaacaagcgcaatggctgattcatcgctccgcacgtacgcttgcaaggctgatcgctgatattaaagccacaactgattgccagtgcgtggtggtcggtggcagcgttgggctggcagaagggtatctggcgctggtggaaacgtatctggcgcaggagccagcggcatttcatgttgatttactggcggcgcattaccgccatgatgcaggtttacttggggctgcgctgttggcccagggagaaaaattatgatgatgggtgaagtacagtcattaccgtctgctgggttacatcctgcgttacaggacgcgttaacgctggcattagctgccagaccgcaagaaaaagcgccgggtcgttacgaattacagggcgacaatatttttatgaatgtcatgacgtttaacactcaatcgcccgtcgagaaaaaagcggaattgcacgagcagtacattgatatccagctgttattaaacggtgaggaacggatcctgtttggcatggcaggcactgcgcgtcagtgtgaagtgttccaccatgaagatgattaccagctttgcagcgccattgagaatgagcaaaccatcatcctgaagccgggaatgttcgccgtgtttatgcctggagaaccgcataagccgggatgcgttgtcggcgaacctagtgagattaaaaaggtggtagtgaaggttaaggctgatttaatggcttaaaacttagttcgttttaaagattctgcagacactgtctgcagaattcgaaattgctgaaattatcggcgtctatagccttcctctagcaccgcctgtgttcgaacgagttcatccgcgagtcgtttttcatcaggtagttgcatcttatattcactcgccagaacggtgttaggcaaaccagccagtgcataatgcgcttctccgactcctttctctgcacagagaatcagaccgatgggcggattttcatccggtagcgtccagtgctctttggcgtagttgagatacatattcatctgtccggcatcgctatagctaaatttgcccacttttagatcgacgattagcaggcagcgtaaacggcggtggaaaaacagcagatcgacccgaaaccagttgtcatcaatgcgtaaccttcgctgccgaccaacaaaggcaaaatcatccccaagttccagcatgaaatccatcaggtggttgatcagcgcctcctcaaaatcggattctgagtattcatctttcaattccagaaattcgagcacaaagggatcgcgtatcgcctgctgcggaagaatatgcatctcggcaggagcgtgttgttgcagcatggctgatttatcatgtgacagtagtgttcgctcataaaattgggtcgcaatttgccgctctagctggcggacagaccaaccacagcggagcgtctctttttcataaaagctgcgggcgtcagcgtttttaacggaaagtagacggacgtaggtggaccagggcagggggaaagatttggcagacagcgtctgccaaatctttgccgatgggaattctgcagacggtgtctgcggcattcccaatggtgttaattcgccagacactgtctggcgaatttcaacatgttgaaaaaagaggtaaaaaagcctcatttggcgtaagttttttgcagagaacccacgcttataccttagacttaaatcctttgatagtcgcttgattagctgcgcaccatacgcagccctggcctcaccgccttgttcaaattcgacaattcgtcggccaatttcccagtacgtcgcggtcattaacgcgttaacgctacgtaccgtttccgttcgggcgctatcgaccagatgaataatgccgtcgtggatttgctggtagcctgctgtggttctctctgagagcgattccattatctgtccctttttatggcgctgtgttgaataatggaatcagctatacgccgggcatctgccggtaacaatccagatgagcgtattacattggttttcttcagattatgcgaggcgctttccagaaagaaaggagaatttcagcgccgactcttttctgaggaggcggcgctgggacagagcttaaacttccagccagttcataatgccgtctgccgccttacgaccttcggcgatggcggtaacgaccagatcggaaccacggacgatatcgccgccagcaaagattttcgggttgctggtctggaaggcgttgtcgctgccttccggggcgatgatgcggccttgtgaatccagctcgacgctgtgttttgccagccattccatgttgtgtggacggaaaccaaacgccatgatcaccgcatctgccggaacgatatgttcggaacctgccacgatctccgcgcggcgacggcctttggcatccggttcgcccatttcggtacgtaccatttttacgccgctgactttgccgttaccgttcacttcaatccccagtggctggacattgaatttgaactctacaccttcttctcgcgcgtttttcacttcgcggcgggaacctggcatgttctcttcatcacgacgataggcacaggtaacgtgcttcgctccctggcgtacagacgtacgcacgcagtccatcgcagtgtcgccaccgccaagtaccaccacgcgtttgccttccatgctgacgaacggttcttcgcgggtttcgccaaagcccattaactgtttggtgttggcgataaggaacggcagcgctgcgtatacgccatcggcgtcttcgttttccagcccgccgcgcattgactgataagtcccgacgccaaggaacacggcatcgtaatcactcagcagatcgtccagctgtacgtcgcggcccacttcggtattgagtttgaattcaatacccatgccggtgaagatttcacggcggcgcgtcattacctctttttccagcttgaaagccggaataccgaaggtcagcaatccgccaatttccgggtgacggtcgaagacgaccgcttttacgccgttgcgcgtcaggacatccgcgcacgccagacccgccgggcctgcgccgataatcgccacttttttaccggtctgtttcacgccggacatatccggacgccagcccatctcgaacgctttatcgttgatatagcgctcaatgttgccgatggtcactgcgccgaactcatcgttcagggtgcaggaaccttcgcacagacggtcttgcgggcagacacgtccgcatacttccggcagagtgttggtctgatgcgacagttccgccgcttcaaaaatacgcccctcgttggcgagcttcagccagttcgggatgtagttgtgtaccgggcatttccactcgcagtatgggttgccgcacgacaggcagcggtcagcctgcgctttggcctggccttcggaaaacggctcgtaaatttcaacaaactcaattttgcggatcttcagcggtttctttggcggatcaacgcgctgcaggtcgataaattgataaacattctgactcattgttgctaccccttactgcgcctgcacgcgcaactctgctgcgctacgactacggtgacccagcagtgcttttacatcactggacttcggtttaaccagcgcaaatttagtggcgaaggttgaccagttcgccagaatctcttcaccgcgctgagagccagtatactgaacatgctcggtgataagtccacgcagatgctcttcatggatcgccaaatcgtcaacgcttaagacctcgaccagttccgggttaacgcgtttgcggaaatcgccgctttcatcgagaacgtaagcgaagccgccagtcatgccagcgccgaagttaacgccggttttacccagaatacagacaataccgcccgtcatatattcacagccgttgtcgccaatgccttctaccacggtgatagcaccggagttacgcacgccgaaacgttcacccgcgcggcctgcggcatacagacgaccaccggtcgcgccatacaggcaggtgttgccgataatgcttgcttcgtggctgcggaaggctgaaccaaccggaggacgaatggcgattaagccgcccgccatgcctttaccgacatagtcgttggcatcaccggtcaggtacagttccacgccgcccgcgttccacacaccgaagctctggcctgcggtgccgttgaagtacgctttgatcggatcggctgccagaccctgatcgccgtgcgtctgggcgatatagcctgaaagcgacgcgccgacagaacggtcggtgttgcgaatatcgaaccagaaggttttgctctggcgctcatcgacaaacggtttcgcctgttgcagcaactgcgcgttcagcaggccgttatcaaacggcgggttgttttcggtgcagtagagcgccttaccgggatgcggctcggcggtctccagcagtttcgacagcgccagtttctgctgtttggcggtgaaaccgtccagctctttcagcaggtcggtgcgaccaatcagatccaccagccgcgttacccccagctgtgccatcagctcgcgggtttcacgggcgataaactcaaagtaattcgtcactttgaacggcaggccgtgatagtgattcttacgcagtttgtcatcctgagttgctacacccgtggcgcagttgttcaggtggcaaattcgcagatatttacaaccgagcgcgaccattgggccagtgccgaagccgaagctttctgcgccgagaatcgccgctttgatgatatcaacgcccgttttcaggccgccatcaacctgcaaacgaattttatgacgtaaaccgttggcaaccagcgcctgttgggtttccaccaggccgagttcccacggacagcctgcgtatttcaccgatgaaagcggacttgcgccggtgccgccatcatagcctgcgatggtgattaaatcggcataagctttcgccacgccagtcgcgatggtgcctactcccggttcggaaaccagcttcacggagatcatcgctttcgggttaacctgcttgaggtcgaaaataagctgcgctaagtcctcgatagagtagatatcatggtgcggcggcggggagatcagcgtcactccgggcaccgaatagcgcagtttggcgatgtaaggcgtgactttatcgcccggtaactgaccgccttcgcccggcttcgcgccctgggcgactttaatctgaatgacgtcggcattgaccagatacgccggagtaaccccaaagcgaccggaagccacctgcttgatgcgcgacactttgttggtgccgtagcgtgccggatcttcgccgccttcaccggagttagagttgccgccgatgctgttcatcgcttcagccagcgcctcgtgggcttccgggcttaacgcgccgatagacatcgcagcggtatcgaagcgtttaaacagttcgcttgccggttcaacatcagcaatgttgaccgcgttttcacccggcgtaattgccagcagatcgcgcagcgtggttgccggacgctcattaaccagcttcgcgtattcctgatagtcgctgtactcgccgctttgtaccgcctgttgcagtgtgcgcaccacgtccgggttgtaggcgtggtattcgccaccgtgcacgtatttcagcaggccgccctggctgatgggcttacgcgccagccaggcacgtttcgacaggttcagcagatcctgctggaagtcttcaaagcttgccccaccaatgcggctaacagcgccctggaagcacaggcctacgacatcatcgtgcagaccgaccgcttcaaacagtttcgagcagcggtaagaggcgatggtggagatgcccattttggacatgattttgtacaagcctttgttgatgccgttacggtagttgagcatcacggtacgataatctttggcaatcgcgtgggtgtctaccaggcggcccagcgtttcataggcaaggtacggataaatagccgtcgcaccgaagcccagcaacacggcgaaatggtgcggatcgcgggcgctggcggtttcgacgatgatgttggcatcgcaacgcaagctttgatcgaccagacgggtctggatcgcgccaaccgccatcggagccggaaccggcaggcgatctttagcgatattccggtcggagagcaccagcagcacagtgccgctacgtaccattttttcggctttgtcgcacagctctttgaccgtcgcttcgagcgtggttttagtgacgtcaaaggtgatatccagtgtatctgcgcggtagtgctcctctttcatcgtcgtgagctgtttgaaatcggagtagagcagaatcggcgatttaaagcttaaacggtgcgcctggccctctgcttcgcaaaagacgttcatttcacgaccgatactggtggcgagcgacataacatgcgcttcacgcagcgggtcgattggcgggttagtcacctgggcaaactgctggcggaagtagtcgtaaataatgcgcggctgactggagagcacggcgaatggggtgtcgtcacccatcgaaccgaccgcttcctgaccgttttcgcccagtacgcgaattacggagtccagctcttccgcgctgtagttaaactgtttctgatagctggcaagcgtgtcgtcgtccagttcgcggctacccacttcttcatcgggcagatcttcaaacggtaccagacggcggacgtttttctccatccactctttataagggtggcggcttttcagatcgtcatcggtttctgccgagtgcagaatacgcccactgcgggtgtcgataaccatcagttcgcctggcccgacgcggcctttttcgaccacttcgtcaggctggtaatcccagataccgacttcagaggcgcaggtgatgagcttatctttggtgatgacgtagcgcgccggacgcagaccgttacggtcgaggttacaggcggcaaaacgaccgtcagacatcacgatgcccgccgggccatcccacggctccatatgcatggagttaaagtcaaagaaggcacgcagttccgggtccatatccgggttgttctgccaggcgggtggtactaacagacgcatggcgcggatgatatccatcccgcctgccagcagcagttccagcatgttatccatggaactggagtcagaaccggtttcgttgacgaacggcgcggcgtcgtgcaggtcagggatcagcggcgtctggaatttataggtacgcgcacgcgcccattggcggttaccggtgatggtgttgatttcaccgttatgcgccaggtagcggaacggctgcgccagcggccagcgcggtacggtgttagtggagaagcgctggtggaacaggcaaatggccgattccagacgcaggtccgcaagatccagataaaagcgcggcagatccgccggcatacacagacctttatagatgttcaccagattcgacaggctacagacgtagaagtctttgtcggcttcgagacgcttttcaatgcggcggcgggcgataaacagacggcgctccatatcgcgcggacgccagcctgccggggcgttcacaaaaatttgctcaatgcgtggcagagaggagagggcgatttcacccagcacgccttcgttggtggggacatcacgccagcccacaatcgataaggtttcgcgttgcagctcttcttcaacgatgcggcgtgcggcagcggcgagttcaggatctttattcaggaagagcatcccgacggcgtagtttttcgctaaacgccaaccgcgctcctgcgcaacgatgcgaaaaaagcgatccggtttttgtaacagcaagccgcaaccgtcaccggttttaccatcggcgagaatcgcgccacggtgctgcatgcgggccagtgcgtgtattgcagtacgcactaccttgtggctaggttcgccttctatatgggcgatcaggccgaaaccacagttatccctctcaagggatttatcgtacaacatatcgtgaacctcccccaggctctgcgggaaccccacttccgaaccgctgcgcacgggcacagaaagagcgtggcgacggggtttgcgtgtcatacgcgcgcctcgcattcgcccccttgttgtccttttcgcatcggttaatacggtgaagaggggatctcaattactgcataaatatgatgagcaggctgctcatccagaaagcttccagcggatttccaacttatcgggaaagatgatacaggtcaaatggcaagcttattggtacagaaatgtgctttagcgcaaaattctttattaatttgctgaaattaaagtggattttctatttaaggctaaaaggggcgtcggtagagaaacagccaattcctgactgtcataaaggcgtgttaacccttatcctgccttgaactgacgagaaaaccagcattttatactgccttaattggtaatggcattttatgctactgtttttgcctaaaatctataaggagataaaaaaaatctgacacaagataagcaaaaatgatttatgtgatcatgcatgaaatttcggtaattttgattgattatgcagttgataaaagcaggccgggacgattgatccaggtcatcgccgaattgagctaaaaatggcaggctttggcctcttttcaaggcgcggtctatcagattatgcagttacagaaattagtcaatatgtttggtggtgatctcacccgtcgttatgggcaaaaggtgcataagctgacgctgcacggcggttttagctgccctaaccgtgacggtaccatcgggcgtggcggctgcacattctgtaatgttgcctcgtttgccgatgaagcgcagcaacatcgttctattgccgaacaactggcgcaccaggcgaatttagttaaccgcgctaaacgctatctggcctactttcaggcgtataccagcacctttgcggaagttcaggtgctgcgttctatgtatcagcaggcggtgagccaggccaatattgtcggtttgtgtgttggtacccgcccggactgcgtgccggatgcagtgctggatctgctttgtgaatataaagaccagggctacgaagtgtggctggagctggggctacaaaccgcccacgacaaaacgctacatcgcatcaaccgcggccatgattttgcctgttatcagcgtacaacccagctggcacgtcagcgcgggctgaaggtgtgttcccacttaattgtcggcctgcctggcgaagggcaggctgaatgtttgcaaacgctggagcgagtggttgaaactggcgtggacggcataaagctgcatccgctgcatattgtgaaaggcagcattatggcgaaagcctgggaagcggggcgtttgaacggtattgaactggaagattacacgctcactgccggagaaatgattcgccatacgccaccggaagtgatctaccaccgcatttccgccagcgcccgtcgcccgacgctgcttgctcctctgtggtgcgaaaatcgatggacgggaatggtcgagctggatcgctatctgaatgaacatggcgtacagggatcggcgctgggacgtccgtggctacctccaacggagtaggccattgaggggaattccgcatttctcacacaatttataacgtaactgtcagaattgggtattattggggcaggttgtcgtgaaggaattccctaatgaagcaaattcgtctgctggcgcagtattatgttgacctgatgatgaagttaggtctggtgcgcttctcaatgttgctggcgctggccctcgtcgttcttgccattgtggtacaaatggcggtaaccatggtgctgcatggtcaggtcgaaagcattgatgttattcgttctatcttctttggtttgctgattacgccgtgggcggtctactttctatcggtggtcgtcgagcaactggaggagtcacgacaacgtctgtcacgactggtgcaaaaactggaggagatgcgcgagcgcgatttgagcctcaacgttcagttaaaagataatattgcccagctaaatcaggaaatcgccgttcgtgaaaaagcggaagcagaactgcaggaaaccttcggccaactgaaaattgaaatcaaagagcgcgaagagacacaaattcagctcgagcagcaatcctcattcttacgttccttccttgacgcttcacccgacctggttttttatcgtaacgaagataaagagttttccggctgtaaccgcgcgatggagctgctgaccggaaaaagcgaaaaacaactggttcacctgaaacctgctgatgtttactcaccggaagccgctgcgaaagtcattgaaaccgatgaaaaagtgttccgtcataatgtgtcactgacctatgaacagtggctggattacccggacgggcgcaaagcctgttttgaaatccgtaaagtgccgtactacgaccgcgtgggtaaacgtcacggtttgatgggttttggtcgcgacattaccgagcgtaagcggtatcaggatgcgcttgaacgcgccagccgcgacaaaacgacgtttatttccaccatcagtcacgaattgcgtacaccgctgaatggtatcgtcggcctgagccgcattctgctggataccgaactcaccgccgagcaggaaaaatatctcaaaaccatccatgtttcggccgtcacgctcgggaatatcttcaacgatattatcgacatggataagatggaacggcgtaaggtccagcttgataatcagccggttgatttcaccagcttccttgccgatctggaaaatctctccgcattgcaggcgcaacaaaaaggattgcgctttaatctggagcctacgctgccattaccgcatcaggtcattaccgacgggacgcgtttacggcagatcctgtggaatctcatcagtaacgccgtcaaattcacccagcaaggccaggttaccgtgcgcgtgcgctacgatgaaggcgatatgctgcattttgaagtggaagactctggtatcggcattccgcaggatgagctggataaaatctttgccatgtattaccaggtgaaagacagtcatggcggtaaacctgccaccggcaccggtattggtctggccgtttctcgtcgtctggcgaaaaatatgggcggcgatattacggttaccagcgaacagggcaaaggttcaacctttacgttgacgatccacgcaccgtcggtggctgaagaggtcgatgatgcgtttgatgaagacgatatgcctttaccggcgctgaatgtgctgctggtggaagatattgaactgaacgtgattgtcgcacgctctgtgctggaaaaattaggtaacagcgttgatgtcgccatgaccggcaaggcggcgctggaaatgtttaaaccgggcgaatacgacctggtgttgctggatattcagttgccagatatgaccgggctggatatctctcgtgaactgacgaagcgttatccgcgcgaggatttaccgccgctggtggccttaaccgctaacgtgctgaaagacaagcaagagtacctcaatgctggaatggatgatgtgctgagtaagccgctttctgttccggcgctaaccgcgatgatcaagaaattctgggatacccaggatgatgaggaaagtacggtgacgacagaagagaacagtaaatcagaagcattgctcgatattcccatgctggaacagtatctcgaacttgtaggaccgaagctgatcaccgacgggttagcggtgtttgagaagatgatgccgggctatgtcagcgtgctggagtcgaatctgacggcgcaggataaaaaaggcattgttgaggaaggacataaaattaaaggtgcggcggggtcagtggggttacgccatctgcaacagctgggtcagcaaattcagtctcctgaccttcccgcctgggaagataacgtcggtgaatggattgaagagatgaaagaagagtggcgtcacgacgtagaagtactgaaagcgtgggtggcaaaagccactaaaaaatgaccccggctagaccggggtgcgcgaatactgcgccaacaccagggaaatcttggctgcgccgtaaattattatgatgagttacaagggcacagcactgtttttcaggctgcacgcagttaagatagcaaaacttaaatgatttgttacatgaatcagttaaatgtgtgatgcgtagcatttttattaaaaaaattaatgtgtttcagtcaattgcgaaaggatgatcacaatgaagaaaattggcgtaattctgagcggatgcggcgtctatgacggttctgaaattcatgaagcggtgttgacgttgttagctatttcacgcagcggtgcgcaggcggtctgctttgcaccggataagcagcaggttgatgttatcaaccatttaacgggcgaagcgatgacggaaacgcgcaatgtgctgattgaagcggcacgaataacgcgcggtgaaatccgtcctctggcccaggccgatgccgctgaactggatgcgttgattgtgccggggggttttggcgcggcgaagaatttaagcaattttgccagtcttggtagcgaatgcaccgttgaccgtgaattaaaggcgctggcacaagcgatgcatcaggccggaaaaccgcttggttttatgtgtattgccccggcgatgctgccgaaaattttcgatttcccgctgcgtttgaccatcggtactgatatcgataccgcagaagtgctggaagagatgggcgcggagcatgtgccgtgtcctgtcgatgatatcgtggttgatgaagacaataagattgtcaccaccccggcatatatgctggcgcagaacattgcagaagcggcgagcggcattgataagctggtttcccgcgtgctggttctggctgaatgagtaaaagccgcttaacggtgtttagtttcgttcgccgttttcttctgcggttaatggttgtcctcgccgttttctggggcgggggcatcgcgttgtttagcgttgcgcctgttcctttctcagcggtaatggccgagcgacaagtcagcgcctggctgcatggcaattttcgttacgtggcacattctgactgggtcagtatggatcaaatttcgccgtggatgggactggcggtgattgccgcagaagatcagaagtttcctgagcactggggctttgatgtcgcctccattgagcaagccctggcccacaacgagcgcaatgaaaaccgtattcgcggtgcgtcaacgatttctcagcagacagccaaaaatctctttttatgggatgggcgtagctgggttcgaaaagggctggaagctggattaacgctggggatagaaactgtctggagcaaaaagcgtatcctgacggtttacctgaatatcgccgaatttggcgacggtgtgtttggcgtcgaagctgcggcacaacgttatttccacaaacccgcgagcaaacttacacgctcggaagctgcattactggcagctgtattacctaatccacttcgtttcaaagtctccgcgccatcgggctacgtgcgtggccgtcaggcgtggattttacggcagatgtatcagttaggcggtgagtcgtttatgcaacagcaccagcttgattaagcttcgcgcgaagtgagggccagcgttttgctctcacgaggttgcagatctttctgcagggcaatagccagcgccggttgggcgataaatcgtttccataaccgctcttgcttacgcagacaacaccacttcgaccaggtcgccagtggaatcaatgtgctttcaccaatgttgtcgcagacgacggggataacctctgactcactgatgcggtgacagaggatattctgcggcttcagcgacatcgtcacgatacggttatcctgcaaataacgcttcagctgtttcagtatctggcgcagttgtgcaatgtcttcttcgtaacggcattgttcagcaaattcggtcagcgtaatggagggtttgccgtcaaaatctgcaatcacatcgtagacataaccggttccgcaatccgtctcaacggtaccgtgatagcgcggtattccactccagtcttttaaccggcgaccaagatgcgcgtagtactttaactcacggcggatctctttatcgccaccatcgccacgatggtagacaatcttgatacagcgttgggcatcttccggatgcgcataacatttccgatgtcttccggtgcccaggggactttgttcagataagcgaatcatgccatctcctggaaatattttctgacgatctccagtatggtcgattaacttaaacgaaacctaaacaatgcttcttaaggttttcttaaggttcttctgaaagtaaaaagcgcacgaaatgtacaattgacgttgattgagaacgatttcagtacgcgcttttcttattgccgggggagcttgaagggatttgaatgtcaaagtgatgaagattaatcttcatcaaaaccagagttaaagagggcgataacggcggccagtgcttcctcttcctgtggaccggtcgcttcaacttcaatctgccgtcctttggcagaatccaacatcagcagcgcaataacgctgttggcttcagcctcggtgccttcgtcattacgtaacagcacttcagcgtcaaaaccttgcattaattcaaacagcttcattgcaggccgggcatgcatgcccagcttgtttgtgatttcaacagtttgcttgacggtcatggtttacgtttttccagcgtacgatggcgtgactggacatttttaccgcgcgagcggaagtagtctgccagttgctctgcaatatacaccgaacggtgcttcccgccggtacaaccaatggcgaccgtcaggtagctacggttgttggtttccagcataggtaaccatagctcaagatagcttcgcgtctggtagataaaattgtgtacttctgtgtggcggtcgaggaacgcggcgacgggcttatcaagacctgtcattggacgcagtttcggatcccagtgcgggttcggcaagaagcgcacgtcaaagacgtaatctgcatcgatagggataccgtgtttgaagccgaaagactcaaagaccatggtcagttcacgttcacgtttacccagcagacgggtacgcagcatttctgccagctcgtgaacggacatttctgaggtatcgacaatcagatccgctcgcgaacgcagaggctccagcaaatcgctttctttgtcgatagcactttccagcgacaggtttttgctggaaagcggatgcagtcggcgcgtgtcactgtaacgacgaattaaggtattacggtcggcatccaggaacaggagttgcggtgagaaagcgtcaggcaggttactcatcgcctgttcgaatatttctggtgactccggcatattacgaacatcaatgctgacggcggcagaaatctcgcgatcggccagagttcgagccagatcgggtaacaacactacgggaaggttatccacgcagtaaaaacccatatcttccagcgcacgcagggcgacagatttacctgaacctgaacgtccgctgacgatcatcagtaccatgtactgtttctcctcacaacgtctaaaagagacattaccgaataactacgcttcatccggagtaccttcggtatccgtaatgatttgatacagctcttcatcgctctgggctgcgcgtaaacggcggcagatggttttgtccgccagacgtttcgccaccagtgacagagtatgcaggtgcgttttagtttggtctgccggcaccagcagggcaaaaagtaaatccaccggttggttgtcgatggcatcgaaagctataggcgtttcgagctgaacgaaaacgccaacggcgcgaagagtatcttcttccagtttgccatgcggaatggcaataccattgccgataccggtactgcccattttttcccgcgtcaggatagcttcaaaaaccacctgaggcggcagactaagttgtttcgccgccagctcgctgatgatttccagggcgcgttttttgctctgacagtggacgcggcttcgcgtacattccctgttaagaacactgctaagctgtagagttgtatcattatttgtcataatttcacctaagaacctgcccactcaaacagtggaacaggctcggagcattaaccgtacaaatggcccgttgtgccgcacaacaggccgccatgcacatgctaattgcccggacaattagtgttgtttcagtttatctttatgtttggtcaactggcgtgccagcttatcaattaagccatcaatggcagcgtacatgtcctgaccttccgcgctggcatgaatttcaccaccgtttacatgcagtgttgcatctgaggtgtgggtgactttctccactttcagaacaacatagacctggttgattcggtcaaaatattgctcaagtttggcaaatttggctgtaacaaattcgcgcagtgcctcggtgatctcgacgttatttccggtaatgttgagctgcatagtgtcttccttatcggttgggtcaaacgagctgtttacgctggtttgacggcggaatggataaagactctcggtacttcgcaacagtgcggcgtgccaccatgataccttgttccgacagcaaagaggttaacttgctgtcgctcaacggtttcgctgggttttccgccgcgattaatttcttcaccagcgcacgaatcgccgtggaggaggcttcgccgccgccctcggtattgacgtgactggaaaagaaatacttcagttcaaaaatgcctcgtggactatgcaggtatttttgcgtggtcacgcgagatatcgtcgattcatgcatttcgacagcctgggcgatatcggccagtaccatcggtttcatatattcttcgccttgctcaaagaaggcttgctgctgttcaacgatacagcgactcacgcgcagtagcgtatcgttacggctttccagactcttgatcaaccatttggcatcctgcagattgctgcggataaactggctgtcaccatcgttgcgcgcgttattgcacatcgaggcgtagtgctggttgatttgcagacgcggaatgctgtcactgttgagttctaccgtccagtgaccgttatgcttacgcaccagcacatctggaatgacatactcaggttcgcccgtctggatcgactgcccggggcgcggatcgagcgactggatcagattgacggcttctttcagcacatcttctttcagacgcgtgacgcgcattaaagtgcggaagtcgtgattggctaacagatcgagatgatcgctaataatcagtctggcctcttccagccacggcgtggttttatcgaattgggagagttggatcagcaggcagtcacgcagatcttttgccgccacaccgaccggatcaaaccgttggatccgcttaaggacggcttcaacttcgtcgatgtcgatctcttcatcgcccatactttcgagaatatcttccagcgggacagtcagataaccggtgtcatcaacggcatcgacgatagaggtagcaatggcgcggtcagtatcggaaaacggtgtcagctcgacctgccacatcaggtaatcctgcaaggtctgcgtcgtttcgccctgatagaccggcagctcgtcgtcaatgtagtcaccgctggtgccggatggtgtaccagcggtgtaaatggtgtcccaactggcatcgagcggcagctcttccggcatctctttttgttcgagcgcgtcggcggtgtccagtgtttcactgtcttgcgtttcgcgggtgtcgatttcttcatgagtgtcgatttgctcaagcagcggattactctccagcgcctgctgtagctcctgctgaagttccagcgtcgacaactgcaacagacgaattgcctgttggagctgtggcgtcatcgccagttgttggctaagcctgagttgcaaaccttgcttcatgttcagaatcgtactctcctgctaaaacgtcgcaaacttctaccctatcagagtctgaagtcttccccaaggtatacacgcttaacgtgttcgtcttgtaagatttctgtaggcgtgccgtgggcgatcaaatgcccctgactgacgatataagcgcgttcacaaaccgccagtgtttcacgcacgttgtggtcagtgatcagtacgcccaggccgctgtcgcgcaggtgctcaatgatgcgtttaatgtcgataaccgagatcgggtcaaccccggcaaacggttcgtcgagcagaataaatttcggattcgcagccagtgcgcgggcaatttctacacggcgacgttcacccccggagagtgactgccccatgctgtcacgcaggtgctcaatgtgaaactcttccatcagctcgttcgcgcggtcttcacgttgttcagcagacaagtcgtcacgaatttgcagtaccgccatcaggttatcgtaaacgctgaggcgacggaaaatggaggcttcctgtggcagatagccgataccgcggcgcgcgcgtgcatgcagaggcagcagactgatatcgtcatcatcaataatgatgttgcccgcatcgcgcggcacaatgcctacaaccatgtagaaagtggtggtcttaccggcaccgtttggccccagcagaccgacaatttccccggagttgacggtcaggctgacgtcttctaccacgcgacggcctttataggcttttgcaaggttctttgcagttaatgttgccataacgaattaattacccttcttctgtgccggggtctggcctttgttgtttttgtcctgcagctgcgacggcaccagaacggtggttacgcgcttacctttgtcgctgaaagcctgcattttctgctctttcaccaggtaagtgatcttatcgcccttaatgttgctatcgacctgctgcagataagcattacccgtcagaacgacaaaatcttttgccagttcgtagtgcatctgggaagcgtgaccttcaacgggtttaccattgtcctgcatctggtagaacgttgccggtttaccgtagccgtcaatcacttctttaccttgttcgccgcccggacgggtaacgaccactttgtcggcattaattttgatggtgccctgggtgacgatgacattaccggtaaaggtaaccacgttgccttgcatatcaagagattgctggtccgattcaatgtggatcggctgatcagtgtctccggttacggcaaatgccggaatgctggcggccagaagtgagctggcaagcacaagattaaggctgagtttgtttgttttgaatttcataggatgttctaaccttttcaatcagctcggcgttcttgctgcgtaagttgccgcgcattttcagaccgctggagttaaatgttgttccgtataacgtgacgaggtcttcagaggtaacatcctgcgtcaccagattgatctgcgcgttatccgtcgtgattctgcgaagttgagagtccggcacaagtgcgttgacttcaacgtgtccatataaatagagcatccggtcattggtcagcttggctttatctgcttttacggaccatgtcgggattttatccttatcaaacgtggtaagtaccggctgcgtaaaccacgaaacggcctgatcggaataatattcaacgtgttgagcaatcaatcgatagcttagtgccccttctgggttatagacgagcgtgtccgtatgctcgcttttataggtgggatcattgttgttgacgaccacctgggcggtatcgtctttttcggccatattaatgccgatcatcaccagaaccgccagtgatagcacaatgataacccaacgtctggctttactcatatcgattgccctttggcttcatccagtttgccctgcgccaggagtaataagtcgcaaacttcacgcactgcaccacgaccgccagcaatgcgcgtcacgtaatcggcgcgcgggagcaacagtggatgcgcatcggccacggcgacgcttaaacccactttttccattaccggccagtcgatgagatcatcgccgacataagccacattttccggggcaatcgccagtttttccagcaaatcgctaaaggcgatcagtttgtttgactgcccctgatacaagtgagtgatccccaatgtggcacaacgatcttctaccagtttagcctttcgcccggtaatgatagcgacttcaatatcagaggtgagcgcacaacgaatgccataaccgtcacgaacattgaacgctttcagctcttcgccattattgcccatataaatcaggccatctgacagtacgccatcgacatcgaggatcagcagacgaatgttctctgcttttgctataacgtcggcgctgacagggccgtaacaggtcgcaagcgacgcacctgctttgctcattgttgtttatccttgaatctttacactacgcctgcacgcagtaaatcatgcatatgtaacacaccgagtaaatggtcgccatcggcaaccatcacggaggtgatatggcgggactgcattaagttcagtgcctcaacggccagaatgccagggcgcacacgtattccccccggcgtcataacatcggaaatacttaactgacgaacatccacgcccatatcgaagacacggcgtaaatcaccgtcggtaaagatgccttcaatcatcatattgtcatcgcaaatgacagtcataccaagatttttgcgggtaacttccagcaatgcgtcacgcagactggccgttttcttaacatgcgggatctcatcgcccgtatgcataatatcgtttacgcgcagcagaagtttacgacccagtgcgccgcctggatgtgagagcgcaaaatcttcagcagtaaagccgcgtgcttttaacagcgcgacagcgagggcatcgcccataaccagcgtggcggtggtgctgctggtcggtgccagccctaacggacaggcttctttcgctactttaacacacagatgcacatctgcggcgcgcgccatgctgctctccgggcgaccggtgatgcagattaacggtacgtgaagacgcttaagcactggaattaaggccgtgatttcgctggattcacctgagttagagatagcaatcaccacatcctgtggggtgaccatgcctaaatcaccatgcgcggcttcaccaggatggacgaaaaatgaaggtgtaccggtgctggcaaacgttgccgccattttgcgcccaatatgccccgatttccccatccccatgacgacaactttccctttacaccagaacatcttttcacaggcaagcgtgaaattctgattgatgtattgatcaagctccgccaggcattcacgttcaatcgccaggacttctttacctgcttgctgaaagtcaaaacccggttgtaactctacgtgcgacataatgcgtttccagttattcaacgagtattggcgataaccagtacaacatcgccagccatacgataaatccgccagttaataatacccctacaccacggcccgattgcggggagcgccgccagcacagcaacgcaaaaataatgctcaccagcaacatcacgctgtagtcacgactgtacgccagtggatcaatctctcctggcgttatcagcgcgggtaaacccaacacgatgacaatattaaaaatgtttgcgccaatgatgtttccgacagcaatgtcgttttcacctttgcgaacccccgctattgcggttgccagttccggcaggctggttccgatagcaattgccgtcagccccatcgtcaactcgctgatggcaaagtaattcgccagcaccgtggcgttatcaaccaccatccgcgtggccactggcatgatgataagcgcaatgccgagccataaaaacgcgacgggcaatccaccttcacgcggcagctctgcaagctgctctctggtcagactgtcagtcccctgacgttcagcctgacgtgcaagtttaacaatgaacagcagccatagcacagccagaaagaggagaaagataccatcgctgcgactaagttgtccgtcatagagtacggaaccggccaccacgctgaccaacaacattaagggtaattcacggcgtagaacatcagaatggacggtaaaaggacgaaccagcgcagccagaccgaggatcagcaatatattgataatgtttgagccgagggctgtaccaacggctaaatcgcgttgttcgtgcagagacgcggcaagcgagacgatgatttctggtaacgatgtaccaatactgaccaccgtcatgccgatgatcagcggcgggatgccaaaggttcggcaaagaatagacgcggcaaaaaccaggcggtcggcactgtaaacgaccaaaagtaaaccaacaattaacagtgccgtagctaaaagcatctaacgtcctttcttcaggtatactcgccggtccgctgaagattttcagaaagccgtaacggattcttaattttgactttatgcggctaaaaagtaaaacaaatgccagctttcgctaaccacggcgggtaatattctgtaaatatgttgggttcaaggttaaattgagcgccatgcttagaaaatcaacgcaagacgaagggtgaattatggagcagtctgtggcgaatttagtcgatatgcgcgatgtcagttttacgcgtggcaatcgctgcatcttcgataatatttccctgaccgtgccgcgagggaagatcacggcgatcatggggccatcgggcatcggtaaaacgacgctactccgtctgattggcgggcaaatcgcaccagatcatggtgagattcttttcgatggtgagaatattccggcgatgtctcgttcgcgcctgtatacagtgcgcaaacggatgagcatgttatttcagtccggggcgttgttcactgatatgaacgtatttgacaacgtcgcctatccactgcgcgaacatactcaacttcccgcgccattgttgcatagtacggtgatgatgaagctggaggccgtggggctgcgtggagcggctaaactaatgccttctgaactttccggtgggatggcgcggcgtgcagcgctggcgcgtgcgattgcgctggagccggatctcatcatgtttgatgagccctttgttgggcaagatcccatcaccatgggcgtactggtgaagctgatttctgagctgaacagcgcgctgggtgtgacttgtgtggtggtttctcacgatgtgccggaagtgttaagtattgccgatcacgcctggatcctggcggacaaaaaaattgtcgctcatggcagtgcccaggcgttgcaggcgaatcctgatccgcgcgtacgtcagtttctggacgggatagctgacgggcctgttccgttccgctatcctgccggcgattatcacgctgatcttttaccagggagttaagccactcatgctgttaaatgcgctggcgtcgctcggacataaagggattaaaaccctgagaacgttcgggcgggccgggttaatgttattcaatgcgctggtcggcaaaccggaatttcgcaaacatgcgccgctgctggtgcgccagctctataatgtcggcgtcctgtcgatgctgattattgtagtttctggcgtgttcatcggaatggtgttggggctgcaaggttatctggttctgaccacttatagtgcggaaaccagtctgggtatgctggtggcgttatcgctactgcgtgaactggggccggtggttgccgcgttgttgtttgccgggcgtgctggttcggcgctaaccgcagaaatcggcctgatgcgcgctacagagcaactctccagtatggagatgatggcggtggatccgctgcgtcgggttatttctccccgtttctgggctggggttatttcattaccactgttgacggttattttcgtcgccgtggggatctggggcggatctctggtcggcgtcagttggaaaggcattgatagcgggttcttctggtcggcaatgcaaaatgccgtcgactggcgtatggatctggtcaactgtctgattaagagcgtggtgttcgccatcacggtgacgtggatttcgttgtttaacggctacgacgccatcccgacgtctgccgggattagccgggcaaccactcgcaccgttgtccactcgtctctggctgttctggggctggattttgtgctgaccgcattgatgtttgggaattgagttcatgcaaacgaaaaaaaatgaaatttgggtgggtatctttttattagcagcactactggcggcgctgtttgtttgcctgaaggcggcgaacgtgacgtccatacgtactgaaccgacctacacgctttatgcgacgttcgataacattggcggcctgaaagcgcgctctccggtcagcattggtggtgttgttgtgggccgggtggcggatattacgctggacccgaaaacctatctgccgcgcgtaacgctggaaattgaacaacgttataaccacattcctgataccagttcgctgagcattcgtacttccggcctgctgggggaacaatatctggcattaaacgtcggttttgaagacccggaactggggactgctatcctgaaggatggcgatacaattcaggacaccaagtctgcgatggtgctggaagatcttattggtcagttcctttacggtagtaaaggcgatgacaataagaatagtggcgatgcgccagctgctgcgccaggtaataatgaaaccactgaacctgtgggtacaacgaaataatttcaggagaaccgacgcatgtttaaacgtttaatgatggtcgctttgctggtgattgcaccgctgagtgcggcaaccgcggcagaccagaccaatccgtataagctgatggacgaggcggcgcagaaaacgttcgatcgcctgaagaatgagcaaccgcaaattcgggccaacccggattatctgcgtaccattgtcgatcaggaactgctgccatacgtacaggtgaaatacgccggtgcgctggtgctgggccagtattacaagagtgcgacccctgctcaacgtgatgcttactttgccgctttccgtgagtacctgaagcaggcttacggtcaggcgctggcgatgtatcacggtcaaacctatcagattgcgccagaacagccgctaggcgataaaaccattgtgcctattcgcgttaccattattgacccgaatggccgcccgccggtgcgtctggacttccagtggcgtaaaaactcccagacgggcaactggcaggcttacgacatgattgctgaaggcgtcagtatgatcaccaccaaacaaaacgagtggggaacgctgctgcgtaccaaaggtatcgacggcctgactgcacaactgaaatcgatttctcaacagaaaatcactctggaagagaaaaaataatgagcgagtcactgagctggatgcagacgggtgacacgctggcgctatccggagagctggatcaggacgttctgctaccgctttgggaaatgcgtgaggaagcggtgaaggggattacctgcatcgatcttagccgtgtgtcccgcgtggatacgggtggactggcactgctgctccatcttatcgatctggcgaaaaagcagggcaacaacgtgacgcttcagggggtaaacgataaagtgtataccctggcgaaattgtataatttgcctgctgatgttctgcctcgttaaattttttcaggccggatatggcgttaacgcctgtccggcaaacctgcctgcaagtcgagccttgtctgatttatcagcgaggctttttgcttatttatgccagcgcaactttgctctaagatgtttcgctggtttattaactgatgattgaagatcccatggaaaataatgaaattcagagcgtgttgatgaacgctctctccctccaggaagtccacgtttccggcgatggcagccactttcaggttattgccgtgggtgagttgtttgacggcatgagtcgggttaaaaaacagcagacggtctatgggccgctgatggaatatattgcggataaccgcattcatgctgtgtcgatcaaagcgtatacccctgcggagtgggcgcgcgatcgcaaactgaacggcttttgagctatgggcgattcgccggtagcggatatgaattgttaactgagaacaaactaaatggataaatttcgtgttcaggggccaacgaagctccagggcgaagtcacaatttccggcgctaaaaatgctgctctgcctatcctttttgccgcactactggcggaagaaccggtagagatccagaacgtcccgaaactgaaagacgtcgatacatcaatgaagctgctaagccagctgggtgcgaaagtagaacgtaatggttctgtgcatattgatgcccgcgacgttaatgtattctgcgcaccttacgatctggttaaaaccatgcgtgcttctatctgggcgctggggccgctggtagcgcgctttggtcaggggcaagtttcactgcctggcggttgtacgatcggtgcacgtccggttgatctacacatttctggcctcgaacaattaggcgcgaccatcaaactggaagaaggttacgttaaagcttccgtcgatggtcgtctgaaaggcgcacatatcgtgatggataaagtcagcgttggcgcaacggtgaccatcatgtgtgctgcaaccctggcggaaggtaccacgattattgaaaacgcagcgcgtgaaccggaaatcgtcgataccgcgaacttcctgattacgctgggtgcgaaaattagcggtcagggcaccgatcgtatcgtcatcgaaggtgtggaacgtttaggcggcggtgtctatcgcgtgctgccggatcgtatcgaaaccggtactttcctggtggcggcggcgatctctcgcggcaaaattatctgccgtaacgcgcagccagatactctcgacgccgtgctggcgaaactgcgtgacgctggagcagacatcgaagtcggcgaagactggattagcctggatatgcatggcaaacgtccgaaggctgttaacgtacgtaccgcgccgcatccggcattcccgactgatatgcaggcccagttcacgctgttgaacctggtggcagaagggaccggcttcatcaccgaaacggtctttgaaaaccgctttatgcatgtgccagagctgagccgtatgggcgcgcatgccgaaatcgaaagcaataccgttatttgtcacggtgttgaaaaactttctggcgcacaggttatggcaaccgatctgcgtgcatcagcaagcctggtgctggctggctgtattgcggaagggacgacggtagttgatcgtatttatcacatcgatcgtggctacgaacgcattgaagacaaactgcgcgctttaggtgcaaatattgagcgtgtgaaaggcgagtaatcgtctgagagctggcagccccgttcgcggggctaccgccagaccactcattttttcggtttagtgtagctacgtatcaactgcgttctgtcgataaactcatgggtcagcggatcatggtagcgagatggccagataatccaggggtcagttcccagggctttcgcaataatcatctctcctttcggccaggggcgcgataatgcgttcgccagcgttgaggaactcaaaccatttctgcgagattccgccgccattgacgttcccttcttgcgcaaacccgcaatgatgtcagcgggatgccagtcaatgaaattactttccatctttcctcactccttaagttagtcgctttcattcagaacacttcttctgtcgagcatcactatactcctgatggcctattgctctaaaaagttcctgtaaagagtgtgaatattcagaatatataaagatgtacagccctattttcaggtgttatagagctgaataagtgtttttatggaatttactggaatcatcccgcgcgctgcgcgggatgaggggaggggattaacgatcgcgttgaacagcgatgtgcgcgaggccgatgagtgcttctcgccacggggtgtccgggagcacctgtaacgctgcgatggctttgtctgcttcttcctcggcacgctgacgcgtccattcaagagatccacaagcgttcattgcttccagaaccggttccagaagatggcgaccgttaccctgttcgatggcggtacgaatcatctgtgcctgttctggtgtgccatgatgcattgcatgcagcagcggcagcgtcggtttaccttcgttcagatcgtcgccgacgtttttacctaactgttcgccatcggcattgtaatcgagtaaatcgtcgatcaactggaaagcagtgccgagatagcgcccataatcctgcaggcctttctcctcctccggcgtacagccagccagaatcccggaacactgcgcggcagcctcaaacagacgcgcggttttgctatagataacgcgcatgtagttttcttcagtgatgtccggatcgttaacgttcatcagttgcagaacttcaccttctgcgatgacgtttacggcttctgacatgacttccagcactttgagcgagccgaggctggtcatcatctggaacgcgcgggtataaataaaatcgcctaccagcacgctggcggcattgccaaatgcggcgttggcggtagctttacccctgcgcatatctgattcatccacaacgtcgtcgtgcagcagagtcgccgtgtggataaactcgatcagggcagcaatggtgacatgcgcatttccctcatagccaacagctcgtgcagccagtacagcaatcatcgggcgaatacgtttaccgccgccgctgacgatgtaatagcctaactgattgatcagttggacgtcggaattaagctgctcaaggattgccgcattaacacccgccatatcttgcgcggttaactcattgattttttctaaattcatcgcaaaagccgggcttttcgccccgattaccttactgtgaacaaaggcaagttagggtttatggttaggaatatagggtgattgtactgaaaaaatggcacagataaacgttaccgtacaagttgtgttttttttcttcgtgtattgactgtagcacttgtcaaaggcgtgcgttttgcgtaatattcgcgccctattgtgaatatttatagcgcactctgaatcattgaaaaggtgtgcgcggaagcggagttttatatgtacgcggttttccaaagtggtggtaaacaacaccgagtaagcgaaggtcagaccgttcgcctggaaaagctggacatcgcaactggcgaaactgttgagttcgctgaagtgctgatgatcgcaaacggtgaagaagtcaaaatcggcgttcctttcgttgatggcggcgtaatcaaagctgaagttgttgctcacggtcgtggcgagaaagttaaaatcgttaagtttcgtcgtcgtaaacactatcgtaagcagcagggccatcgtcagtggttcactgatgtgaaaattactggcatcagcgcctaagacctgaggagagatttcaaatggcacataaaaaggctggcggctccacacgtaacggtcgcgattcagaagctaaacgcctgggcgttaagcgtttcggtggcgaatccgttctggcgggtagcatcatcgttcgtcaacgtggtaccaaattccacgctggcgctaacgtaggttgcggtcgtgaccacactctgtttgctaaagcagacggtaaagtgaaattcgaagttaaaggcccgaaaaaccgtaaatttatcagcatcgaagctgaataagtttttcgcgtcccggtaacggatgaaagccccgcaacacgttgcggggctttttacattcgataaccggtaaaaatgcgcatggtgcgacgttaattcgcaaatgcgctttgcagggaatacggtatgaagcagcaggcaggcattggcattcttttggcgctcaccacagcaatttgctggggggcgttgccaatcgcaatgaagcaggtgctggaggtgatggaacctccgacaatcgtgttttaccgtttcttgatggcgagtattggccttggtgccattcttgcggtgaagaagaggttgccgccattacgcgtgtttcgtaagccacgctggttgattttgttggcagtggcgaccgccgggctgtttgggaacttcatcctgttcagctcatccttgcaatacctgagtccgaccgcttcgcaggtgattgggcaactctcgccagttggcatgatggttgccagcgtatttatcctgaaagagaaaatgcgcagcactcaggttgtaggggcattgatgctcctgagcggtctggtgatgttttttaacaccagtctggtcgagatatttacaaagctcaccgattacacctggggagttatctttggggtcggtgcggcgacggtttgggtgagttatggcgtggcgcaaaaggttttattgcgtcggctggcctcaccgcagatcctgtttttactgtacactttatgtacaattgcgctcttccctctggcaaagcctggagtgatagcgcagcttagccactggcagctcgcatgtttaattttttgcggactgaatacattggtaggatatggcgccctggcggaagcgatggctcgctggcaggcagcgcaggtgagcgcgatcatcacgctcaccccactgtttacgctgtttttttcagatcttttatcactggcctggcccgatttcttcgccagaccgatgttaaaccttttaggttatctcggtgcgtttgtcgtggttgcgggcgcgatgtattccgccattggtcatcgtatttggggcggattacgtaagcatacaacggtggtatcgcaaccgcgcgcaggcgaatgatttacggagaataaaatgaagtttgttgatgaagcatcgattctggtcgttgcaggtgatggcggtaatggttgcgtgagcttccgccgcgaaaagtatattccgaaaggcggcccggatggcggcgatggcggtgatggtggtgacgtatggatggaagccgacgagaacctgaacacgcttatagattatcgttttgaaaaatctttccgtgcagagcgtggtcagaacggcgcaagccgcgactgtaccggtaagcgcggtaaagacgtcacgattaaagtgccggtaggtacgcgtgtaatcgaccagggtactggtgaaaccatgggcgatatgaccaaacacggtcagcgtctgctggttgctaagggcggctggcacggtctgggcaatacccgtttcaaatcgtcagttaaccgtacaccacggcagaaaactaacggtacgccgggcgataagcgtgagctgctgctggagctgatgctgctggctgacgtcggtatgttggggatgccaaacgcgggtaaatcgacctttattcgcgcggtatcggcggctaaaccgaaagtggcggattatccgtttaccactctggtgccaagtctgggtgtggtacgaatggacaacgaaaagagcttcgttgttgccgatattccaggactgattgaaggcgctgcggaaggcgcaggtctgggcattcgcttcctgaagcacctggaacgttgccgcgtcctgttgcacctcatcgatatcgatccgattgacggcaccgatccggttgaaaacgcgcgtattattatcagcgagctggaaaaatacagccaggatctggcagcgaaaccgcgttggttagtcttcaacaagatcgacctgctggataaggcagaagccgaagagaaagcgaaagcgatcgctgaggcgctgggttgggaagataaatattatctgatctctgcggcgagcggactgggcgtgaaagatctctgctgggatgtgatgacctttatcattgaaaacccggtcgtgcaggctgaagaagcgaaacagccagagaaagtcgaattcatgtgggatgattatcaccgtcagcagcttgaagagattgctgaagaggatgatgaagactgggatgacgactgggacgaagacgacgaagaaggcgttgagttcatttacaagcgttaatcagcaaaaccccggccatgtgccggggtttcttattgactaattgttctgataaatatctttatacaaacggctttcaaaacgtaccaacggaatacggcgattacgctgatccgccggttctactgcatagccagaaagatattgcacaaacgccattcgttgcccgctcgctgtggtaatgaatcccgccaggttatataccccctgcaacgaaccggttttcgctgagacttttccatccacgcccgcctgatgcagacctgcacggtactgcaaagagccgtcatagcccgccagcggcagcatagagataaagttaagttcattgtcgtgttgggctatgtattgcagcacctgcatcatggtggcgggggcaatcaggttatgccgcgaaagccctgaaccatcggcaataatggtgttaccaatatcgacaccagcttgctggcgcaggatctgacgcacggcgtccgacccggcccgccatgttccaggcacattgaagcgtgcatggcctatcatgcggaaaaccgtatcggcgatcatgttgtctgactttttcagcataatcttaagcagatcgtgcaacggggccgactgtttactggcaactaccgttccaggttcgttaacctgcgtctgacgcagcagtgttccgctccaggtgatacctgcctgttttaactcatctttcagaattgccccagcatagctggcaccatcctgcacggcaaaagccaacgggagcggctcagaacgttgtggcaggcatccggtcagcgtaaagcggttcaggtcgcctggcaccacatccagctcgcaatattgcgcttcggcagacccacgggggagggtgcgtacctggctgaacatcgtaacggggtaataagatgccacgcgtataaaagccatatcaccgggtttttgggcactgtagagcgagacggagaaacagttgcggtcaactatggcggcggcaggcggagcgctaaagcattgtgtcatgtcattccatggccagccgggggctttatcgtggctggcgaaaatggaggtatctatcaacacattgccatcgattttgttgacgccagattttttcaaagtcgcgaccatattgcgaatatcctgacgttttaacgtcggatcggcaccaaatcgcgccactaagtcacccttaagtacgccgttttccacattgcctttggtttcaagcgtcgtggtgaaacgaaaatcggggccgagttgaatcaacgccgccagcgcagtaatcactttctgggtactggcgggcagcgccatctgctgactgtggtaatcaatagcgggggccgacgcgccgactttttgcaccatcagggcaaggttggcaccagcggggagttgagtaacgtactcatcaacattcgcggcctgaacactgaacgctatacagctggtcaatccgatgataaatctggaaaatcgcataatctcgcgctaacaacctggaatcgagccgtcatactacggcgcaacgccctataaagtaaacgatgacccttcgggaacttcagggtaaaatgactatcaaaatgtgaattgtagctgacctgggacttgtacccgggtcggtatttttttgcttctggtcccggtgaggagttatgccgggcaggccgaacagccggggtgggtgaagacttgccccatcaggaatattcaagaggtataacaaatgcaagctattccgatgaccttacgcggcgctgaaaaattacgcgaagagctggattttctgaaatctgtgcgccgtcctgaaatcattgctgctatcgcggaagcgcgtgagcatggcgacctgaaagaaaacgccgaataccacgcagctcgtgaacagcagggcttctgcgaaggccgtatcaaagacatcgaagccaagctgtcgaacgcgcaggtgattgatgtcaccaaaatgcccaacaatgggcgcgttatttttggtgctaccgtaacggtgctgaatctcgattctgacgaagaacagacttatcgcatcgttggcgatgacgaagctgactttaaacaaaacctgatttctgtaaactcacctattgctcgtggcctgatcggcaaagaagaagatgatgttgtggtcatcaaaacgccgggcggcgaagtagaatttgaagtaattaaggtggaatacctgtaagaattacccaatactcaagatgttgatgtattgtaaagaaaggaaaaaggccgctatgcggccttttatcaacgaacagagcgtggcattttgctctcctgcctgcggaaaacccctcgttttacacagcaaatgtgtgtaactttaggataatcttagcgtggcagcgagattttacgttctttagttgggcgataaagcaccagcgttttaccgatgacctgtacattacaggcgccggtttcgcgcacgatagcttccacgatcaaggttttagtttcgcgatcttcggtggcgattttcaccttgatgagttcatggtgctctaacgcttgttcaatctcggccagcaccccttcggtcaaaccattactgccaagcagaacaactggcttgagcggatgtgccagacctttcaggtgctgtttttgtttagtactcagattcatcgtattttttgcttacgttgggattgaaaacgggtcattctaccgccatctcccatatatcaccaaataggcgcgtaaaaatttacgcaattggttacgatgagttatccccatgggaaagttaaatgacaggtaagaagcgttctgccagctccagccgctggcttcaggaacactttagcgataaatatgttcaacaggcacagaaaaaggggttacgttcccgtgcctggtttaaacttgatgaaatacagcaaagtgacaaactctttaaaccgggaatgacggttgtcgaccttggtgctgctccgggtggttggtcacaatatgtggtcacccaaattggcggcaaaggccgcatcatcgcttgcgatcttttacctatggatcctatcgttggtgtggactttcttcagggcgattttcgtgatgaactggtgatgaaagcactgctggagcgcgttggcgacagcaaagtccaggttgtcatgtccgatatggcaccaaacatgagcggaacaccggcggtggatatcccccgtgccatgtatctggtggaactggcgctagaaatgtgtcgtgatgtattagcgccaggtggcagttttgtagtgaaggtgttccagggcgaaggtttcgatgagtatctaagggaaattcgctccctgtttacgaaggtcaaagttcgtaagccggactcttctcgtgcacgttcgcgggaagtgtatattgtagcgaccgggcgtaaaccctaaccgggagatttcagacgaaagtttgaaagatgctggatatagagtatcctgacgctgtttttaacacagttgtaataagaggttaatcccttgagtgacatggcgaaaaacctaatactctggctggtcattgccgttgtgctgatgtcagtattccagagctttgggcccagcgagtctaatggccgtaaggtggattactctaccttcctacaagaggtcaataacgaccaggttcgtgaagcgcgtatcaacggacgtgaaatcaacgttaccaagaaagatagtaaccgttataccacttacattccggttcaggatccgaaattactggataacctgttgaccaagaacgtcaaggttgtcggtgaaccgcctgaagaaccaagcctgctggcttctatcttcatctcctggttcccgatgctgttgctgattggtgtctggatcttcttcatgcgtcaaatgcagggcggcggtggcaaaggtgccatgtcgtttggtaagagcaaagcgcgcatgctgacggaagatcagatcaaaacgacctttgctgacgttgcgggctgcgacgaagcaaaagaagaagttgctgaactggttgagtatctgcgcgagccgagccgcttccagaaactcggcggtaagatcccgaaaggcgtcctgatggtcggtcctccgggtaccggtaaaacgctgctggcgaaagcgattgcaggcgaagcgaaagttccgttctttactatctccggttctgacttcgtcgaaatgttcgtcggtgtgggtgcatcccgtgttcgtgacatgttcgaacaggcgaagaaagcggcaccgtgtatcatctttatcgatgaaatcgacgccgtaggccgccagcgtggcgcaggcctgggcggtggtcacgatgaacgtgaacagactctgaaccagatgctggttgagatggatggcttcgaaggtaacgaaggtatcatcgttatcgccgcgactaaccgtccggacgttctcgacccggcgctgctgcgtcctggccgtttcgaccgtcaggttgtggttggtttgccagatgttcgcggtcgtgagcagatcctgaaagttcacatgcgtcgcgtaccattggcacccgatatcgacgcggcaatcattgcccgtggtactcctggtttctccggtgctgacctggcgaacctggtgaacgaagcggcactgttcgctgctcgtggcaacaaacgcgttgtgtcgatggttgagttcgagaaagcgaaagacaaaatcatgatgggtgcggaacgtcgctccatggtgatgacggaagcgcagaaagaatcgacggcttaccacgaagcgggtcacgcgattatcggtcgcctggtgccggaacacgatccggtgcacaaagtgacgattatcccacgcggtcgtgcgctgggtgtgactttcttcttgcctgagggtgacgcaatcagcgccagccgtcagaaactggaaagccagatttctacgctgtacggtggtcgtctggcagaagagatcatttacgggccggaacatgtttctaccggtgcgtccaacgatattaaagttgcgaccaacctggcacgtaacatggtgactcagtggggcttctctgagaaattgggtccactgctgtacgcggaagaagaaggtgaagtgttcctcggccgtagcgtagcgaaagcgaaacatatgtccgatgaaactgcacgtatcatcgaccaggaagtgaaagcactgattgagcgtaactataatcgtgcgcgtcagcttctgaccgacaatatggatattctgcatgcgatgaaagatgctctcatgaaatatgagactatcgacgcaccgcagattgatgacctgatggcacgtcgcgatgtacgtccgccagcgggctgggaagaaccaggcgcttctaacaattctggcgacaatggtagtccaaaggctccacgtccggttgatgaaccgcgtacgccgaacccgggtaacaccatgtcagagcagttaggcgacaagtaagttcccgcatcagatgactgtatttgtaccgaaaaccccggggcgtgctccggggttttttcttatcaatttataccagggataacaccatgaaactctttgcccagggcacttcactggaccttagccatcctcacgtaatggggatcctcaacgtcacgcctgattccttttcggatggcggcacgcataactcgctgatagatgcggtgaaacatgcgaatctgatgatcaacgctggcgcgacgatcattgacgttggtggcgagtccacacgcccgggggcggcggaagttagcgttgaagaagagttgcaacgtgttattcctgtggttgaggcaattgctcaacgcttcgaagtctggatctcggtagatacatccaaaccagaagtcatccgtgagtcagcgaaagttggcgctcacattattaacgatattcgctccctttccgaaccaggcgctctggaggctgctgcagaaaccggtttgccggtttgcctgatgcatatgcagggaaatccaaagaccatgcaggaagccccgaagtatgacgatgtctttgcggaagtgaatcgctattttattgagcaaatagcacgttgcgagcaggcgggtatcgcaaaagagaaattgttgctcgaccccggattcggtttcggtaaaaatctctcccataactattcattactggcgcgcctggctgaatttcaccatttcaacctgccgctgttggtgggtatgtcacgaaaatcgatgattgggcaattgctgaacgtggggccatctgagcgtctgagcggtagtctggcttgtgcggtcattgccgctatgcaaggcgcgcatatcattcgtgttcatgacgtcaaagaaaccgtagaagcgatgcgggtggtggaagccactctgtctgcaaaggaaaacaaacgctatgagtaatcgtaaatatttcggtaccgatgggattcgtggtcgtgtaggggatgcgccgatcacccctgattttgtgcttaagctgggttgggccgcgggtaaagtgctggcgcgccacggctcccgtaagatcattattggtaaagacacgcgtatttctggctatatgctggagtcagcactggaagcgggtctggcggctgcgggcctttccgcgctcttcactggcccgatgccaacaccggccgtggcttatctgacgcgtaccttccgcgcagaggccggaattgtgatatctgcatcgcataacccgttctacgataacggcattaaatttttctctatcgacggcaccaaactaccggatgcagtagaagaggccatcgaagcggaaatggaaaaagagatcagctgtgttgattcggcagaactgggtaaagccagccgtatcgttgatgctgcgggtcgctatatcgagttttgcaaagccacgttcccgaacgaacttagcctcagtgaactgaagattgtggtggattgtgcaaatggtgcgacttatcacatcgcgccgaacgtgctgcgcgaactaggggcgaatgttatcgctatcggttgtgagccgaacggtgtgaacatcaatgccgaagtgggggctaccgacgttcgcgcgcttcaggcgcgagtgctggctgaaaaagcggatctcggtattgccttcgacggcgacggcgatcgcgtgattatggttgaccatgaaggcaataaagtcgatggcgatcagatcatgtatatcatcgcgcgtgaaggtcttcgtcagggccagctgcgtggtggcgctgtgggcacattgatgagcaacatggggctggaactggcgctgaaacagttaggtattccatttgcgcgcgcgaaagtgggtgaccgctacgtactggaaaaaatgcaggagaaaggctggcgtatcggtgcagagaactccggtcatgtgatcctgctggataaaaccactaccggtgacggtatcgttgctggcttgcaggtgctggcggcgatggcgcgtaaccatatgagcctgcacgatctttgcagcggcatgaaaatgttcccgcagattctggttaacgtgcgttacaccgcaggtagcggcgatccgctggagcatgaatcagtcaaagctgtgaccgcagaagttgaagcggcgctgggtagccgtggacgtgtgctgttgcgtaaatccggcaccgaaccgttaattcgcgtgatggtggaaggcgaagacgaagcacaggtgactgaatttgcacaccgcatcgccgatgcagtaaaagccgtttaaagcgtgagataactggctaaaaaggcggcggttgtcgccttttttctcagcgaacacatcagttttgctgtttttttccgcagttgatacaatgcgataaaattgcccttgcgaaggtcattcgctttggttagtattcacacccgcttcagtgggaaagattaaaaactcccgctttattggttgaagcattggtacgcggcaactccgcaaggaacaggttgattatgtacgaagctcttttagtagttttccttattgtggcaattggccttgttggtctgatcatgctgcagcaaggtaaaggcgctgatatgggagcctccttcggagcaggcgcttccgctacgctgtttggttcaagtggttctggtaacttcatgacccgcatgacggcgctgctggcaacgttattcttcatcatcagtctggtgttgggtaacatcaatagcaacaaaaccaataaaggtagcgaatgggaaaacctgagtgcgccggcgaaaaccgaacaaactcagccagctgctccggctaagccgaccagcgatatcccgaactaaaaagtagtatccgtgccgaggtggtggaattggtagacacgctaccttgaggtggtagtgcccaatagggcttacgggttcaagtcccgtcctcggtaccaaattccagaaaagagacgctgaaaagcgtcttttttcgttttggtcctggtctgaggaatggttgtcaggtatctgtatctcgtccagttgctttactcgtagctggtactttgaaacgatggtgccggtacgccttagttataaacttttcccttctgctgacataattggcactttattgtgtcaactccagttccggtacgaatacggatatgtttacttctcgataaaccatcctgctcctgtcagtataactactgatggctacgttctgcgtaatgtttagagacgcattgataatgttatttaattactgagaacgcaatggccgcatcatttaaaaagaaaaaactaacagtgtttcgttctgatatggatcagagttgaaaaacatgtctgatataaaattgaacattgttgatgattgtttatattggttgtgaacttggatttctggatgacagtattcaacaaatttgctagaagttttaaatctcattggttgttgtatctttgtgttattctttttggtattacgaacttagtcgcttcttccggagcgcatatggttcagcgattgctgttcttcgtcctgaccatcctggttgttaaacgtatatcatcccttccgcttcgcctgcttgttgccgcaccatttgtgttactgactgcggcagacatgagtattagcctctattcatggtgtacctttggtacaactttcaatgatggatttgcgattagtgtgctgcagagtgatccggatgaagttgtcaaaatgctggggatgtatatcccttatctatgtgcttttgcctttttatcccttctttttttggcagtaataataaaatatgatgtttccttgccgacgaaaaaagtgacaggaatattattgctgattgtcatttcgggcagtttattttccgcttgtcaatttgcttataaagatgcaaaaaataaaaaagcgttcagtccatatatactagcgtcgcgatttgctacctatacaccgtttttcaatctcaattattttgctttagcagcgaaagagcatcaaagattactctcaattgcaaacacggtgccgtattttcaattatcagtcagggatacaggtattgatacctacgtgttgattgtgggggagtccgtacgcgtcgacaatatgtctttgtatggatatacacgctctacgacaccgcaagtcgaagcacaaagaaaacagatcaaactgtttaatcaagcaataagcggtgcaccttacactgcgctgtcggttcccctttctttaactgctgattccgttttgagtcatgacattcataattaccccgacaacattattaatatggctaatcaagcaggatttcagactttctggctaagctcgcaatccgcttttcggcagaatggtacagcagttaccagtatcgccatgcgcgccatggaaacagtctatgtcagaggatttgatgaattgttgttgccgcatttatcgcaagcgttacagcaaaagacgcagcaaaagaaactgattgttcttcatttaaatggaagccatgaaccggcttgtagcgcctatccgcaatccagcgccgtgtttcaaccgcaggacgatcaggatgcctgctatgacaactccattcattacacagatagtttgctaggtcaggtttttgaattattaaaagatcgtcgcgcctcggtcatgtattttgccgatcacggcctggaacgcgaccctacgaagaagaacgtctattttcatggaggcagggaggccagccagcaggcatatcatgtcccgatgtttatctggtatagccccgttcttggggatggcgttgatcgtacaacggaaaacgatatcttttccactgcgtacaataattaccttattaatgcgtggatgggggtaacaaagccggaacagccgcaaacgctggaggaagtgattgcacactataaaggagactcacgggttgtagatgcaaaccatgatgttttcgattttgtgatgctaagaaaggagtttactgaggataagcaaggtaaccccacccctgaagggcagggttgatgtcgaattactggcctttattttccagattctccacctgcggcacgcccgaagcggcagaggaggagagcaggccagttttggcataaccgaaaagtttctcgcgggtatcggtgatatccaggttacgcatggtcaattgaccaatacgatcatctggcgagaacaccgagtcacctttttccatcgtcagacgctctggcttgtaggtcaggttctctgagacggtattcaggatcgaataatcgttcccacggcgcagctccagggtaacctcaccagtgatctggctggcaacccagcgttgcagagagtcacgcagcatcagcgcctgggaatcaaaccaacgcccctggtacagcagacggcccaactgacgaccatgtgcatgatactgctcaatggtgtcttcgttgtgaataccagtaagcagacgttcatacgcaatgtgcagcagcgccattcccggagcctcgtaaataccacggcttttcgcttcgatgatacggttttcaatctggtcgctcatgcccaggccgtgacgaccgccgatgcggttagcttccagcatcatttctacgtcgtcgctaaaggttttaccgttcagcgccaccggatgaccttgctcaaagcgtactgtgacttcttctgccgggatcttcacgctctcatcccagaacttcacgcccataatcgggttgacgattttgacgctggagttgaggtattccagatccttcgcttcatgcgttgcaccaagcatattggagtccgtggagtaggctttttcgacagacattttgtagtcgaaaccgcaggcaatcataaattcagacatttcatgacgaccgcccagttcatcaataaagtcagtatcaagccacggtttgtaaatctgcagttcagcattggtcagcagaccgtaacgatagaaacgttcgatatcgtttcctttataggtgctgccgtcaccccagatattcacgccatcttctttcatagcagcaaccagcatggtgccagtcacggcgcggcccagcggcgtcgtgttgaaataggtcaggccgccagtggtgttatgaaatgcgccacactgaatagcggcaataccttcggccaccagttgtttgcggcagtcgatcagacgtgcgttctccgcgccgtattccatggcacgacgagggatcgcatcataatcctcttcgtctggctggcccagatttgcagtatatgcataaggaacagctcccttttgtcgcatccacagcagtgcggcactggtgtccagaccgccggaaaaagcgataccaatacgttgacctaccgggagatgcttgagaatcgtcgtcataaaataacaccctgcttaattaactgatgatgagcctggatttccgctctcactgaatttttatgcaaaataaatgagttttcatttaatcatcttttatcggagacaggaagagtttagtgtgttttttgtaaaataatgcgcttaagggagagcaggagaaggcaaaagtattcaacaaatgaaagtgaactggatattcattcacgtgattagcaataaacgttgacaaaatgtggcgtggatcactataatgcctgcagattttacgtcccgtctcggtacaccaaatcccagcagtatttgcattttttacccaaaacgagtagaatttgccacgtttcaggcgcggggtggagcagcctggtagctcgtcgggctcataacccgaaggtcgtcggttcaaatccggcccccgcaaccactttcccttagagtcctttttcaaatatactgtgaagacttcggccttcgtagtgggatttgaaaaaatccttctggaaagtgctccagaccgcagttgcggttatagggttcagttatataaagccccgatttatcggggttttttgttatctgactacagaataactgggctttaggccctttttttatgtcttgggggtgggcttgtccacattagagcaaaaattaacagagatgattactgcgccagttgaggccctgggttttgaactggttggcatcgaatttattcgcggtcgcacatccacactgcgcatctatattgatagtgaagatggcatcaatgttgatgattgtgctgatgtgagccaccaggtaagtgctgtgctggatgttgaagatcccatcaccgttgcttataacctggaagtctcctcaccgggtctcgatcgcccactgttcacggctgaacactacgcccgtttcgtcggagaagaggtgactctggttctccgcatggcggtacaaaaccgtcgtaaatggcagggcgttatcaaagcggtagacggtgaaatgatcacagttaccgtcgaaggtaaagatgaagtgttcgcgctgagtaatatccagaaggcgaacctggttccccacttttaatagtctggatgaggtgaaaagcccgcgatgaacaaagaaattttggctgtagttgaagccgtatccaatgaaaaggcgctacctcgcgagaagattttcgaagcattggaaagcgcgctggcgacagcaacaaagaaaaaatatgaacaagagatcgacgtccgcgtacagatcgatcgcaaaagcggtgattttgacaccttccgtcgctggttagttgttgatgaagtcacccagccgaccaaggaaatcacccttgaagccgcacgttatgaagatgaaagcctgaacctgggcgattacgttgaagatcagattgagtctgttacctttgaccgtatcaccacccagacggcaaaacaggttatcgtgcagaaagtgcgtgaagccgaacgtgcgatggtggttgatcagttccgtgaacacgaaggtgaaatcatcaccggcgtggtgaaaaaagtaaaccgcgacaacatctctctggatcttggcaacaacgctgaagccgtgatcctgcgcgaagatatgctgccgcgtgaaaacttccgccctggcgaccgtgttcgtggcgtgctctattccgttcgcccggaagcgcgtggcgcgcaactgttcgtcactcgttccaagccggaaatgctgatcgaactgttccgtattgaagtgccggaaatcggcgaagaagtgattgaaattaaagcagcggctcgcgatccgggttctcgtgcgaaaatcgcggtgaaaaccaacgataaacgtatcgatccggtaggtgcttgcgtaggtatgcgtggcgcgcgtgttcaggcggtttctactgaactgggcggcgagcgtatcgatatcgtcctgtgggatgataacccggcgcagttcgtgattaacgcaatggcaccggcagacgttgcttctatcgtggtggatgaagataaacacaccatggatatcgccgttgaagccggtaacctggcgcaggcgattggccgtaatggtcagaacgtgcgtctggcttcgcagctgagcggttgggaactcaacgtgatgaccgttgacgacctgcaggctaagcatcaggcggaagcgcacgcagcgatcgacaccttcaccaaatatctcgacatcgacgaagacttcgcgactgttctggtagaagaaggcttctcgacgctggaagaactggcctatgtgccgatgaaagagctgttggaaatcgaaggccttgatgagccgaccgttgaagcactgcgcgagcgtgctaaaaatgcactggccaccattgcacaggcccaggaagaaagcctcggtgataacaaaccggctgacgatctgctgaaccttgaagggatagatcgtgatttggcattcaaactggccgcccgtggcgtttgtacgctggaagatctcgccgaacagggcattgatgatctggctgatatcgaagggttgaccgacgaaaaagccggagcactgattatggctgcccgtaatatttgctggttcggtgacgaagcgtaataaactgtagcaggaaggaacagcatgacagatgtaacgattaaaacgctggccgcagagcgacagacctccgtggaacgcctggtacagcaatttgctgatgcaggtatccggaagtctgctgacgactctgtgtccgcacaagagaaacagactttgattgaccacctgaatcagaaaaattcaggcccggacaaattgacgctgcaacgtaaaacacgcagcacccttaacattcctggtaccggtggaaaaagcaaatcggtacaaatcgaagtccgcaagaaacgcacctttgtgaaacgcgatccgcaagaggctgaacgccttgctgcggaagagcaagcgcagcgtgaagcggaagagcaagcccgtcgtgaggcagaagaatcggctaaacgcgaggcgcaacaaaaagctgaacgtgaggccgcagaacaagctaagcgtgaagctgctgaacaagcgaaacgtgaagctgcggaaaaagacaaagtgagcaatcaacaagacgatatgactaaaaacgcccaggctgaaaaagcccgccgtgagcaggaagctgcagagctcaagcgtaaagccgaagaagaagcgcgtcgtaaactcgaagaagaagcacgtcgcgttgctgaagaagcacgtcgtatggcggaagaaaacaaatggactgataacgcggaaccgactgaagattccagcgattatcacgtcactacttctcaacatgctcgccaggcagaagacgaaagcgatcgtgaagtcgaaggcggccgtggccgtggtcgtaacgcgaaagctgcgcgtccgaagaaaggcaacaaacacgctgaatcaaaagctgatcgtgaagaagcacgcgcagcagtacgtggcggtaagggcggaaaacgtaaaggttcttcgctgcagcaaggcttccagaagcctgctcaggccgttaaccgtgacgttgtgatcggcgaaaccatcaccgttggcgaactggcgaacaagatggcggttaaaggctctcaggtcatcaaagcgatgatgaaactgggcgcaatggcaaccatcaaccaggttatcgatcaggaaaccgcacagctggttgctgaagagatgggccacaaagttatcctgcgtcgtgaaaacgagctggaagaagcggtaatgagcgaccgtgacacgggtgcagcggctgaaccgcgcgcgccggttgtgaccatcatgggtcacgttgaccacggtaaaacctctctgctggactacattcgttcaacgaaagtggcctctggcgaagcgggcggtattacccagcacattggtgcataccacgttgaaactgaaaacggcatgatcaccttcctggacaccccggggcacgccgcgtttacttcaatgcgtgctcgtggtgcgcaggcaacggacatcgtagtcctggttgttgctgccgacgacggcgtaatgccgcagaccatcgaagcaatccagcacgcgaaagcggcgcaggttccggtggtcgttgcagtgaacaagatcgataaaccagaagccgatccggatcgcgttaagaacgaactctcccagtacggcatcttgccggaagagtggggcggtgaaagccagttcgtacatgtgtctgcgaaagcgggtactggtatcgatgagctgctggacgctatcctgctgcaggcggaagttctggaactgaaagcggtacgtaaaggcatggcgagcggtgcggttatcgaatccttcctcgataaaggtcgtggtccggttgctaccgttctggtacgtgaaggtactctgcacaagggcgatatcgttctgtgtggcttcgaatacggtcgtgttcgtgcgatgcgtaacgaactgggtcaggaagtgctggaagcgggtccgtccattccggtggaaatcctcggcctgtccggcgttccggctgcgggtgatgaagttaccgttgtacgtgacgagaagaaagcgcgtgaagttgcactctatcgtcagggtaaattccgcgaagttaaactggcgcgtcagcagaaatctaaactcgagaacatgttcgccaacatgaccgaaggcgaagttcacgaagtgaatatcgtccttaaggcagacgtacagggttctgtggaagctatctccgactccttgctgaaactgtctactgacgaagttaaagtgaagatcatcggttctggcgtaggtggtatcaccgaaaccgacgctaccctggctgcggcgtccaacgccatcctggttggcttcaacgtacgtgctgatgcctctgcacgtaaagtgattgaagcggaaagcttggatctgcgttactactccgtcatctataacctgatcgacgaagtgaaagcggcaatgagcggtatgctgtctccggaactgaaacaacagattatcggtctggcggaagttcgtgacgtattcaaatcaccgaaatttggtgccatcgcaggttgtatggttaccgaaggtgtggttaaacgtcacaacccgatccgcgttctgcgcgacaacgtggttatctacgaaggcgagctggagtccctgcgccgcttcaaagatgacgttaacgaagtccgtaacggtatggaatgtggtatcggcgttaagaactacaacgacgtccgcactggcgatgtgatcgaagtattcgaaatcatcgaaatccaacgtaccatcgcttaaggttgtctgggttgtaggccggataaggcttttacgccgcatccggcagccgttgcctgatgcgacgctcgcgcgtcttatcaggcctacacagccctttccacctgagattaattttaaaaggggctatggccccttttttgtcaggagaatttattatggcgaaagaatttggtcgcccgcagcgcgtagcgcaggaaatgcaaaaagagatcgctctcatcctgcagcgtgaaattaaagatcctcgtctgggcatgatgaccaccgtttccggtgtcgaaatgtctcgcgacctggcgtatgccaaagtatatgtaacgttcctcaacgacaaagatgaagacgcggttaaagcgggcatcaaagcgctgcaggaagcttctggtttcatccgcagcctgctggggaaagcgatgcgcctgcgtatcgtgccggaactgaccttcttctacgacaactcgctggttgaagggatgcgcatgtcaaacctggtgaccagcgtggtcaaacatgacgaagaacgtcgtgttaacccggacgacagcaaggaggactaatgagtcgtcctcgtcgtcgcggtcgcgacattaacggcgtgttgttgctggataaaccgcagggtatgtccagcaacgatgcgctgcaaaaagtgaaacggatttataacgccaaccgtgctgggcataccggtgcgctggacccgctggcaactggcatgttgccaatttgcctcggggaagcgacgaagttttcccagtatctgctggactccgacaaacgctatagggtgattgcgcgtcttggacagcgtaccgatacgtctgacgccgacggacaaatcgttgaagaacgtccggtaacctttagtgcagagcaactggcggcggcgctggatactttccgtggcgatatcgaacagatcccttcgatgtattcagcactgaaataccagggcaaaaaactgtacgaatatgcgcgtcagggcattgaagtaccgcgtgaagcgcgcccgattaccgtttatgaattgctgtttattcgccacgaaggcaatgagctggagctggaaattcactgctcaaaaggcacttatatccgcaccatcattgatgacctgggtgaaaaactcggttgtggcgcgcatgttatttacctgcgtcgtctggcggtaagtaaatatccggttgaacggatggtgaccctggaacatctgcgtgaactggttgaacaagccgaacagcaggatattccagccgcggagttacttgatccattactgatgccaatggacagtccagcttcggactacccggtggtgaatcttccgttaacgtcttctgtttacttcaaaaatggtaacccggttcgtacatccggtgcgccgctggaaggactggttcgcgttacagaaggtgagaacggcaagtttatcggtatgggcgaaattgacgatgaaggccgcgtcgcgcctcgtcgcctggtggttgaatacccggcgtaatgttaaccgtcttgcgataacaggtcgctacgagtagaatactgccgcttaacgtcgcgtaaattgtttaacactttgcgtaacgtacactgggatcgctgaattagagatcggcgtcctttcattctatatactttggagttttaaaatgtctctaagtactgaagcaacagctaaaatcgtttctgagtttggtcgtgacgcaaacgacaccggttctaccgaagttcaggtagcactgctgactgcacagatcaaccacctgcagggccactttgcagagcacaaaaaagatcaccacagccgtcgtggtctgctgcgcatggtttctcagcgtcgtaaactgctcgactacctgaaacgtaaagacgtagcacgttacacccagctcatcgagcgcctgggtctgcgtcgctaattcttgcgagtttcagaaaagggggcctgagtggccccttttttcaagctgacggcagcaattcactggaaactaatgtattgttgctatgaatgatcttccgttgcagaggttcgcgcggctaatgagaggctttacccacattgggctgggttagggttgtcattagtcgcgaggatgcgcagaagatcgggtattaacaccagtgccgtaaggtactgtctaagaaagagaaaggatattacattgcttaatccgatcgttcgtaaattccagtacggccaacacaccgtgactctggaaaccggcatgatggctcgtcaggctactgccgctgttatggttagcatggatgacaccgcggtattcgttaccgttgttggccagaaaaaagccaaaccaggtcaggacttcttcccactgaccgttaactatcaggagcgtacctacgctgctggtcgtatcccgggtagcttcttccgtcgtgaaggtcgtccaagcgaaggcgaaaccctgatcgcgcgtctgattgaccgcccgattcgcccgctgttcccggaaggcttcgtcaacgaagttcaggttatcgccaccgtggtttctgttaacccgcaggttaacccggatatcgtcgcgatgattggcgcttccgcagcactgtctctgtctggtattccgttcaatggtccgattggtgctgcccgcgtaggttacatcaatgaccagtacgtactgaacccgactcaggacgagctgaaagagagcaaactggatctggttgttgccggtactgaagccgctgtactgatggttgaatctgaagctgaactgctgagcgaagaccagatgttgggcgcagtagtgttcggtcatgaacaacagcaggttgtcattcagaacatcaatgaactggtgaaagaagccggtaaaccgcgttgggactggcagccggagccggtaaacgaagcgctgaacgcgcgcgttgctgcactggctgaagctcgtctgagcgatgcttaccgcatcaccgacaaacaagagcgttatgcgcaggttgatgtcatcaaatctgaaaccatcgcgacgctgcttgctgaagatgaaaccctggacgaaaacgaactgggtgaaattctgcacgctatcgagaaaaacgttgttcgtagccgcgtactggcaggcgaaccgcgtattgacggtcgtgaaaaagatatgattcgtggtctggatgtgcgtactggcgtgctgccgcgtactcacggttctgcgctgttcacccgtggtgaaactcaggcgctggttaccgcaacgctgggtactgcacgtgacgcgcaagttcttgatgaactaatgggcgaacgtactgacaccttcctgttccactacaacttccctccgtactcagtaggcgaaaccggcatggtcggttctccgaagcgtcgtgaaattggtcacggtcgtctggcgaagcgcggtgtgctggcagtcatgccggatatggacaaattcccgtacaccgtacgtgttgtgtctgaaatcactgaatccaacggttcctcttctatggcttccgtgtgcggcgcgtctctggcgctgatggacgcaggtgtgccaatcaaagctgctgttgcgggtatcgcaatgggtctggtgaaagaaggcgacaactacgttgtactgtctgacattttgggcgacgaagatcacctgggcgatatggacttcaaagttgcgggttcccgcgacggtatctctgcattgcagatggatatcaaaattgaaggtatcaccaaagagatcatgcaggttgcgctgaaccaggctaaaggtgcgcgtctgcatatcctgggcgtaatggaacaggcgatcaacgcgccgcgtggcgatatctctgagttcgctccgcgtatccataccatcaagatcaacccggacaagatcaaagacgttatcggtaaaggcggttctgtaatccgtgctctgaccgaagaaactggcaccaccatcgaaatcgaagatgacggtactgtgaaaatcgcagcgaccgacggcgagaaagcgaaacatgctattcgtcgtatcgaagagatcactgcagaaatcgaagtgggccgcgtctacaatggtaaagtgacccgtatcgttgactttggcgcatttgttgccatcggcggcggtaaagaaggtctggtacacatctctcagatcgctgacaaacgcgttgagaaagtgaccgattacctgcagatgggtcaggaagtaccggtgaaagttctggaagttgatcgccagggccgtatccgtctgagcattaaagaagcgactgagcagtctcaacctgctgcagcaccggaagctccggctgctgaacagggcgagtaaggttgccatttgccctccgctgcggcggggggcttttaaccgggcaggacgccttgttagcaaccgggaacaggacgttcattcaaccgtggtcttcgggagtgggaaatgaagccttttttgcgctggtgtttcgttgcgacagcacttacgcttgcaggatgcagtaatacttcctggcgtaaaagtgaagtcctcgcggtaccattgcaaccgactttacagcaggaagtgattctggcacgtatggaacaaatccttgccagtcgggctttaaccgatgacgaacgcgcacagcttttatatgagcgcggagtgttgtatgatagtctcggtctgagggcattagcgcgtaacgatttttcgcaagcgctggcaatccgaccggatatgcctgaagtattcaattacttaggcatatatttaacgcaggcaggcaattttgatgctgcctatgaagcgtttgattctgtacttgagcttgatccaacttacaactacgcgcacttgaatcgcgggatcgcattatattacggcggtcgtgacaagttagcgcaagatgatctgctggcgttttatcaagacgatcccaatgatcctttccgtagtctgtggctttatctcgccgagcagaagctcgatgagaagcaggctaaagaagtgttgagacagcacttcgaaaaatcggataaggaacagtggggatggaacattgtcgagttctacctgggcaacattagcgaacaaacgttaatggaaaggctcaaggcggacgcaacggataacacctcgctcgctgagcatctcagtgaaaccaacttctatttaggtaagtactacctaagtctgggggatttggacagcgccacggcactgttcaaactggcggttgccaacaacgttcataactttgttgagcaccgatacgcattgttggaattatcgctcctgggccaggaccaagatgacctggcagaatcggaccagcaatagctgacgtacacatcagcccgtaatcttttttgattgccatcaccttaacgggtgagggcgttgttgttcgttaatacacctactttgagccggttcacacttttcaatgaaaattgctgatcaatttcatgatgagttatgtagactggccgccattaattttgaggcacacgtactacatggctgaattcgaaaccacttttgcagatctgggcctgaaggctcctatccttgaagcccttaacgatctgggttacgaaaaaccatctccaattcaggcagagtgtattccacatctgctgaatggccgcgacgtcctgggtatggcccagacggggagcggaaaaactgcagcattctctttacctctgctgcagaatcttgatcctgagctgaaagcaccacagattctggtgttggcaccgacccgcgaactggcggtacaggttgctgaggcaatgacggatttctctaaacacatgcgcggcgtaaacgtggttgccctgtacggcggccagcgttatgacgtgcaattacgcgccctgcgtcaggggccgcagatcgttgtcggtactccgggccgtctgctggatcacctgaaacgtggcactctggacctttctaaactgagcggtctggttctggatgaagctgacgaaatgctgcgcatgggcttcatcgaagacgttgaaactattatggcgcagatcccggaaggtcatcagaccgctctgttctctgcaaccatgccggaagcgattcgtcgtattacccgccgctttatgaaagagccgcaggaagtgcgcattcagtccagcgtgactacccgtcctgacatcagccagagctactggactgtctggggtatgcgtaaaaacgaagcactggtacgtttcctggaagcggaagattttgatgcggcgattatcttcgttcgtaccaaaaacgcgactctggaagtggcagaagctcttgagcgtaacggctacaatagcgccgcgctgaacggtgacatgaaccaggcgctgcgtgagcagacactggaacgactgaaagatggtcgtctggacatcctgattgcgaccgacgttgcggcccgtggcctggacgttgagcgtatcagcctggtagttaactacgatatcccgatggattctgagtcttacgttcaccgtatcggtcgtaccggtcgtgcgggtcgtgctggtcgtgcgctcctgttcgttgagaatcgtgagcgtcgtctgctgcgtaacattgaacgcaccatgaagctgaccattccggaagttgaactgccgaacgcagaactgctgggcaaacgtcgtctggaaaaattcgccgctaaagtacagcagcagctggaaagcagcgatctggatcaataccgtgcactgctgagcaaaattcagccgactgccgaaggcgaagagctggatctcgaaactctggccgccgcactgctgaaaatggcacagggtgaacgtactctgattgttccgccagatgcgccgatgcgtccgaaacgtgaattccgtgaccgtgatgaccgtggtccgcgcgatcgtaacgaccgtggcccgcgtggtgaccgtgaagatcgtccgcgtcgtgaacgtcgtgatgttggcgatatgcagctgtaccgcattgaagtgggccgcgatgatggtgttgaagttcgtcatatcgttggcgcgattgctaacgaaggcgacatcagcagccgttacatcggtaacatcaagctgtttgcttctcactccaccatcgaactgccgaaaggtatgccgggtgaagtgctgcaacactttacgcgtactcgcattctcaacaagccgatgaacatgcagttactgggcgatgcacagccgcatactggcggtgagcgtcgtggcggtggtcgtggtttcggtggcgaacgtcgtgaaggtggtcgtgaaggcggtcgtaacttcagcggtgaacgccgtgaaggtggtcgtggtgatggtcgtcgttttagcggcgaacgtcgtgaaggccgcgctccgcgtcgtgatgactctaccggtcgtcgtcgtttcggtggtgatgcgtaatcatcgctgaacagcgaacacaatctgtaaaataatatatacagccccgatttttaccatcggggctttttttctgtcttttgtactcgtgtactggtacagtgcaatacataacaacgcagtcgcactatttttcactggagagaagccctcatggcaacactaaccaccacccaaacgtcaccgtcgctgcttggcggcgtggtgattatcggcggcaccattattggcgcagggatgttttctctgcctgtggtcatgtccggggcgtggttcttctggtcaatgacggcgctgatctttacctggttctgtatgctgcattccggcttgatgattctggaagctaacctgaattatcgaatcggttctagctttgacaccatcaccaaagatttgctgggcaaaggctggaacgtagtcaacggcatttccattgcctttgtgctctatatcctgacttacgcctatatttctgccagcggttcgattctgcatcacaccttcgcggagatgtcgctgaacgtccctgcacgggcagctggatttggttttgcactgctggtagcgttcgtggtgtggttgagtacgaaagctgtcagccggatgacagcaattgtgctgggggcgaaagtcattactttcttcctcaccttcggcagcctgctggggcatgtacagcctgcgacattgttcaacgtcgccgaaagcaatgcgtcttatgcgccgtatctgctgatgacactgccattctgtctggcatcgtttggttatcacggtaacgtgccgagcctgatgaagtattacggcaaagatccgaaaaccatcgtgaaatgcctggtgtacggtacgctgatggcgctggcgctgtataccatctggttgctggcgacgatgggcaacatccctcgtccggagtttatcggcatcgccgagaagggcggtaacattgatgtgctggtacaggcattaagcggcgtgctgaacagccgtagcctggaccttctgctggtcgtgttctcaaactttgcggtagcaagttcgttccttggcgtaacgctgggtttgtttgactatctggcagatctgtttggtttcgatgactcggctatgggccgcttgaaaacagcattgttgacctttgcaccgcctgttgtgggtggtttgctgttcccgaacggattcctgtacgccattggttatgctggcttagcggctaccatctgggcggcaatcgttccggcgctgctggcccgcgcatcgcgtaaacgctttggtagcccgaaattccgcgtctggggcggcaagccgatgattgcgctgattctggtgtttggcgtcggtaacgcactggtgcatattttatcgagctttaatttgctgccggtgtatcagtaattgaacgagccggatgagcagttttcatccggcaataattcacaagtacacgagatggtatcaaataaacccctgtttattataaagttcttcagcgagagcttccccgtgctcatcgaaaaaagcatcggcgatagttaaattttctgccttaggatttgccgttattttgctaccattggcatcaaattcgagcgcgatagcggtctccgaaccccaccagtaataataaattagcgcaaaattattttcccctggcgtaataaacttctcgattccccgcacacaggccatgagtggcatgaagatttcatagctctctgagagaaatatgtgatccatcgtgactatctgtgtttctttattaaagttgatatgttcggcataaatattcttttcactttcaccagaattacaagctgcaagattgttaagcatttttgcaggatcgccgtacaaccgctgcttctcgataaaccatggcaaccagtcgtcatggtctttgatatttgttgctggtgaatggaaaaacttctcgaggttactctcggtaatatgtgcatgaagaaaaaaggaagccggttcactcataatgattttctctggtaataagtcgatttgttcatttctctgtttggcgatgataaaacgatgactattttataaaagtacagaactggacctttcatctatttcatatcataagaaaatatatacttgaactggctcagaataagcggaatacgaaatggggcgtaaaggactacttgctattgtattgttgagcctgtttatcgccatgatttttcaatttttctggcctgccccacacgatgaacacgttttcctgccagttgaaaaacctgtcgcaccgtctttaaaaatcattcatcctggtgaccagttatttatccgcattctgaaagcggaagataagctggaactgtgggcaagcaccaacaacaagccttacgaactctataaaaccaggactatatgcgcgtggtctggtggcttagggccaaaacacaaacagggggatggtaaaagcccggaaggtttttatgccaccaacaaagagttgcttaacccaaacagccgctatcatctggcatttaatattggttacccgaatgcttacgatcgggcaaacggctacaccggtgatttcattatggttcacggaaactgcgtttcggcgggctgctatgccatgaccgatgctggtattgaagagatttatcaactggtggcgcaggcgctgaatagcgggcagaagagcgtgccggtgcatatcttcccgtttgcgatggacgaagaaaatatgcgccaggcgcaggtatggccggaatataatttctggcgtatgttgaagcccggctatgattactttgaaaaaaatcgccgattgccaaccatcaccgttgaaaaccggcgttataaaatcagcccaacaactcttccttaacatccatcgccagttcaaacgaatgcaggcgcgcctggtgatcgaaaatctgcccgttaaccataatctcatcggcgtcggtttcgcgcaggatcgactgcaaaccatgacgcactttcgctttatcgcccaccagcgacatactcagcgcctgctgcacgccatactgctcggacggtgaccagaactgatccatattttgaatcggcggcggcagttgcccggtttcgccacggcgcagcttcacaaaggcttgctgcatcgaggtaaacagaaattcagcgtcgcggttgctgtcggcggcgataatattgatgcacaccatcgcatacggtttttccagtcgtgccgacggtttgaagttgctgcgataaagatgcagcgcctggaacaacatatccggcgcgaagtgtgaggcaaacgcaaacggcagaccaagctgcgccgccagttgcgcgctgtaaaggctggagcctaacaaccacacggggattttctcgccatagcccggtaccgggcgcacatgcggattgggatcgcgggcgtcaaaccagtccaccagctccgcgacatcgcgggggaaattatcaatatcgccgctcatatgacgacgtagagccatcatggttcgctggtcactacccggagcacgacccagccccaaatcgattcgccccggatagagcgtattgagcgtgccgaactgttcggcaatgaccaacggtgagtggtttggtaacatcacgccgccggaacccagatgcagcgtggtggtattcgccgccagatagccaattaatactgatgttgcagcactggcaatgccggtcatattgtggtgttctgccagccagtagcgatgatagccgcgcttttcagccagacgggcgagatcgagagagtgggagaacgcttctcgcgctgaagaaccttcgggaatgggggccagatcgagtagcgaaaacgcaatggttttatcagtcataacagctcactttgttaccgattaatctttaatactgcattaaagagtagttaaagttgttaacaaagtgagctatttacttacgcttgcagctccagcccggccagccgccgccagtagccgttacaatcgctgtttgccgtcaacggcagtggcgcagcgccattttcattggcgcggaaggcgtcgagcatagtgaaagtgtcagtcccctgcggtgacaggcggaccacatcgaccagcccctgcatggatgccagctcgttaccgaggttgtaaacgtagccgctcatggtctgaatgccattgagtacaaacacttgctggttttcctgcgacagaacgttgcgcccgttcggatacttaatgcagcaggtttcgcactcatctttcgggcggtcttccgaacgcgcggtaaagcagcgggcggagtaggccagcggcagatgaccgtagctcaagacttccacttcaaactggttgcgaatgcccagctcatcgcactgattaagcagattcaccagccagtcgcgggatagctccaccggcatacaccagcgcatcatgccctgtttgagcaatattttcagggtcaccgcgttgtagcagttcagcgcgtgcccggcgacgaacggcagtttgcgttcagcgcacatattcaccacgccgagatcgctggcttcaatcagaaactcaccgttctcaacatagcgtttcagttcgcccagttcggaggacgcctgcaccagtgccagcgtggagagcacaatctgcttgccacttccggcgagcgatttcgccatctccagccagtcgccaactttggttgcccggcgtttgctacagaccgcttcaccgagataaatcacgtctgcgttgctggcggcggcctgctgataaaaatcttccagcgtctcttttggccagtaccatagcaccggccctaaggaatatttcattgctcttctcactgccatttacggtgatacgcgccaagggtggtctgcgtgccttcggacatcgacccgagcgtctccatccacgcgctttgtggtacgaagttttgcggatcggccttacaacggtcgatagcctgacgccagacttttgccacctggctgacatacgccgggctacgctggcggccttcaattttcaccgaagcgatattcgccgccattaactccggcagtagctcaagggtattgagactggttggttcttccagcgcgtgatagcgctcgccgtccaccagataacgccctttacacagcgtcggataacctgcgttttcgccgtcctgataacggtcgatcagcacttcgttcaggcgagattccagcccctgcggcgtttgctgccagcgcacgaaacgggccggagaacacgcgcccacggtgttgggcgactcacccgtcagatacgacgacagatagcaacgaccttccgacataatgcacaggctgccgaaagcaaagacttccagtggtacaggtgtgacccgtgctagttgtttcacctgatgaatcgacaacacgcgcggcagcaccacgcgtgcaacgtcaaaatggcgatgataaaagtgaatcgcctcttcattagtcgccgaagcctgcactgacacatgacgttcaatatgcgggtaacgctcggcggcgtactccagcatggcgaggtcggcgaggatcagcgcgtcggcacccagctgcgccgccatatccacggcgcgctgccagcgggcgtaaccgtccgggtgcgcaaaagtgttaatcgcgatgtgaagtttgcggcgatgttgatggacaaaactcaccgcttcctgcaattttttctcggtaaagttaaggccggcgaagtgacgggcattggtatcatcttttagcccgatataaacagcatctgcgccgttttcgatggccgccttaagcgccgggagatttccggcagggcagagcagctccataatttttcctgaaggttgcgctatcaaagcgcaaaaatgttaacgaactgggattttagttaaccttgctgcgacaatttttgatttaaggcagttaaagttgtattggtggtagcagcaatttcatatggaattgttgatttataccgctatgttatttttctgatatggcaaaataggatgattgttgaaacagggagtaaaactcgtgttggataaactgcgttcccgtattgtgcatttggggccatctctgttgagtgtaccggtaaaactgacgccatttgcgctaaaacgccaggttcttgagcaggtcttaagctggcaattccgtcaggcgctggatgatggcgagctggagtttcttgaaggccgctggttaagtattcatgtgcgtgatattgacctgcaatggtttacctcggtggtgaatggcaaactggtcgttagccagaacgcgcaagctgatgtgagttttagtgccgacgccagcgatctgctgatgattgcggcgcgtaaacaagatccggatacgctcttcttccagcgtcggctggtgattgaaggcgatacggagctggggctgtatgtgaaaaacctgatggacgccattgaactggagcaaatgccgaaagccttacgcatgatgctgctgcaactggcggattttgttgaggcgggaatgaaaaccgcgcctgaaaccaaacagacatcggtaggtgaaccatgctaattcgagtagaaattcccattgatgcgccgggtattgatgccctgctgcgtcgttcattcgaaagtgatgcggaagcgaagctggttcacgatctgcgtgaagatggctttctgacgctggggctggtggcgacagatgacgaaggtcaggtcattggctatgtggcatttagtccggttgatgtgcagggcgaagacctgcaatgggtcggcatggcaccgttggcggttgatgaaaaataccgtggacaagggctggcacgccaactggtctatgaaggactcgattcgcttaatgagttcggctatgccgcagtggtgacgctgggcgatccggcgctgtacagtcgtttcggctttgagctggcggcgcatcacgatctgcgttgccgctggccgggcactgaaagcgccttccaggtacatcgtttagcggatgacgcgctgaatggcgtaaccggtctggttgagtatcacgagcacttcaatcgcttttaacctttggggtttgcaggctgctcaacagttctgcaaaccctgcgccttccgctaccagacgttctttttgccgtttggtcagttgcttaacgcgatattctgcccgtaacgccagcgaacgatcgcccactggcgcggaaaacgccagcgttagttctcctttcccgcgcagtgctttcgcccctttgccgctttggtgctgctgatagcggcgttcgacatccgtggtgatcccggtataaagcttattgtcggcggtacggatcaagtaaagaaaccagggtgtcatcgtctgcgtcgcatgttaaggtcaggcccacagtataaaagagaacagcaatggaaacactcaccgccatcagccgttggctggcaaaacaacatgttgtcacctggtgtgtgcagcaggaaggggaattgtggtgcgccaatgccttttatctttttgatgcgcagaaagtcgccttctacattttgacggaagaaaaaacgcgccacgcgcagatgagtgggccgcaggcggcagttgccggaactgtaaacggtcagccgaaaacggtagcgttaattcgcggcgtgcaatttaaaggcgagatccgcaggcttgaaggtgaggaaagcgacctcgcacgcaaggcgtacaaccgtcgctttccggttgccagaatgctgtcggccccggtatgggaaatccggcttgatgaaatcaaattcaccgacaacacgctgggctttggtaaaaaaatgatctggctacgtaactcaggcaccgagcaggcgtaacgcctcgcggttaaacgctggcagatcgtccggcgttcggctggtaaccagctgatctttatcgaccaccacttcctgatcgtaaaattccgcgcccgcgtttttaacatcaataatgatcggtttaactgcagtcagtttgcgcccccgaatcacatcggcactgatcagcaactgcgggccgtgacagatggcgaaaactggtttgccgctattcacaaaatcacgggtgaaagtgacaaaacggttgtcgccacgcagataatccggtgaatggccgcccggtagcagcagggcatcaaactccgctggcgtcacttcatcgatggatttatcgatggtcacgctggcttctccttttttgcctttcaccgttttacccgcttgcttttcaatggtaatcacttcgtgtccggctttacggaactcgtctgcgggtgaagtaaattctgaatcctcaaattcatcagtgattaaaacggcaattttcttactcatgcttcctccgcgttgttgcattggatgaggcgaatttcccacaatcggggataattacctcatggtctattaagcctggtgcatgagccggggagcgcaaggcagacaattctgtaaaggagcgaagatgagtcaggtactgattacaggcgcaacggggctggtgggcggtcacctgctgcggatgttgattaacgaaccgaaagttaacgccatagccgcgccgacgcgacgtccgttgggcgatatgcccggggtgtttaatccccatgatccgcaactgaccgacgcgctggcgcaggtcaccgatcccatcgacattgtgttttgttgtctcggcaccacgcggcgagaagcggggagtaaagaggcgtttattcatgccgattacacgctggtagtggataccgcattaaccgggcggcggttgggcgcacagcatatgctggtagtcagtgctatgggtgccaaggcccactcgccgtttttctataaccgcgtcaaaggggagatggaagaagcattaattgcccagaactggccgaaattgaccattgctcgcccgtcgatgttactgggcgatcgtagcaaacagcggatgaacgaaacgctttttgcgccgctgttccgtttgttacctggtaactggaaatccattgatgcgagagacgtggcgcgggtcatgctggcagaggcgatgcggcctgagcatgaaggtgtgacgattttaagctcttcagaattacgcaaaagagctgaataattattcccaagaattgatagtgagcgtaatattcacgcgctcaattatcataacttattcctggggaatgctatgactggtcagtcttcatctcaggcggcaacgcccattcagtggtggaaacccgcgcttttctttctggttgtcattgccggtctctggtatgtgaaatggcaaccttactacggcaaagcgtttactgctgccgaaacccacagtatcggtaaatctatccttgcgcaggcggatgctaatccgtggcaggcggcgttggattacgcgatgatctatttcctcgcggtatggaaagcggcggtgctgggggtgatcctcggttcgttgatacaggtgctgatcccgcgtgactggttgctgcgtacgcttgggcaatcgcgctttcgcggcacgctgctgggaacgctgttttcgctgccgggcatgatgtgtacctgctgtgcggctccggtcgcggcgggaatgcgtcgccaacaggtatcgatgggcggggcgctggcattctggatgggcaatccgttgttaaacccggcgacgctggtgtttatggggtttgtcctcggttggcaatttgccgcgattcgtctggttgcaggccttgcgatggtgttgctgattgcgacgctggtacaaaaatgggtacgtgaaataccgctaacgcaggcaccggtcgaaattgacataccggaagcgcagggcggattttttagccgctggggcagggcgctatggacgcttttctggagtacgatcccggtttacatccttgcagtactggtgttgggtgccgctcgcgtctggttattcccccatgccgatggtgctgtcgataacagccttatgtgggtggtggcgatggcggtagcaggatgcttgtttgtcattcccacggcagcagaaattccaattgtgcaaacgatgatgctggcaggtatgggaaccgctccggcgctggcattgttgatgacgctcccggcggtgagtttgccgtcactgattatgctgcgtaaagcgttcccggcgaaagccttatggctgacgggggcgatggtggcagtatctggtgtgattgtcggcgggttggcgctgttggcctaagatgttggatgctcctgaatacagcactggacggtcccctctcccctttggggagagggttagggtgaggggaacaggtcggctaaggtgtgaatatttacttcaacgaccgatcaatggcttatttaataaacgtaaacgctgtggttacccgcttcacgccgcttacccggctggcaatatctgccgccgctttcgcttcacgttcagtcactagccccatcaggaacacttcaccgttttcggtggtcactttcacgttggacgatttcaccaggtcgctggttaacagctgcgaacgcactttggtggtgatccacgtatcgttagacgcttcgcccagaccaatcggctggccctgacgaatctcgttatacacttcgttggcaccgtcgacgcccatcgcaatttgtttagcgcgagccgaaagttcagcgtttggtgactgcccaaccagcagcactttgccctgataagccgtgacattaatacgggtttctttcttaatctgttcgtctttcgacaatgcgctgtttacgcgcacttccagggtaccatcgtccacctgggtgccgacactgcgtggatcagttgcggctttggtacccacagcagcggtacccactacggcagcggcaacacaaccttgcaacagcagcgcggaaagaaggactgcgattggcgataatgccttcatgtattctccttaaacatcctggtgagggaaaagcgtgttatcgatcagatcgcacaggcaatttaccgtcagcatatgcatctcctgaatgcgagcactacgatgcgaaggaatgcggatctccacatcctgtggccctaacaaacctgcaagttcaccgccgtcatagccggttaatgccacaatggtcatatcacgcgtaacggcagcttctaccgcttttacaatatcgcggctgttgccacgggtggaaatggctaacaatacatctcccgcatgacccagcgcccgcacctgttttgcatacacttcatcatgtaagcgatcgttggcaatcgccgttaagacaacattatcagtatttagtgcaatggcaggtaagctgggccgctccgtttcgaaacggttgatcatgctggcagcaaaatgctgtgcattggcagcggaagttccattaccacaacagaggattttgttgccattgagcagagactgaaccagcgtcatggctgcacgggagatggcatccggaagcgcctctgccgccgcaatttgagtttgaatgctttcagtgaagcaagctttaattctttcttgcacgctaatccttaaaccttaattatgagtggtcattaaaggcatccttaatccactcaacctcattcccggtgaaggctaccacatcgaaccggcaatccacagtatcaaaactcccattatgacgcgcgagccacaagcgggcagtctgtaataatttgtgttgtttgctgcgggtcacactggctgccgcgccgccataaagcgcagagcggcggtaacgcacctcgacaaaaacggtggtccggccttcacgcattatcagatcgatctcgccgccacgctcgttcacgttagcggcgataaaccgcagtcctttgccttccagccagcgacgcgcttgtacttcccacgcatcgccggtctgtttggtggttaactggcggggactacctgaccttgttggtactgtagccatgataacttcctgttaatcacgcaatccgggttagccgtcagacttccggtattaccgttgatttcaaaaccctgaacctggcgcatttgtgagaaatgatttgccaacgaccaggcatcaacgcccatcgcatacatgcgagccagcgaataatcgttgttcaccgcgctgagcgcctgctgcattaacggcagattaccgcctgccagcatcgggatttcgctgtactgcaagccttccatctccaggcggaaatccgggccagcggtcccttgcgcactgcgggagctggcgtacagcgtcgcaccgctgtgactgccgttacgcatggcgatcatcggtttgataaaagcgatttcacccggcgttgccacaatgtacaccgcatcgacacgaccgccattattggtgaactggtcatcggttggcgtggtttgcagcgttggattgttggtcgtcatgccggagtcggttgtcgctctgggagtaatcgggctacccgttaaagcaataccagaaccgccgttaacacccgcgcgtaattcgctggtggaaccaaatttttgttgcagaacggtgccgccacccagtttctgccactcttgcgcaaacgcattggctacgcgatcgcccaatgaactgcgtgggatcagcaccagcggcgcttgtttaccctggtcacgaatatgacgcgctgcatcgcgcgcttcgtcttccggtgaaagcgcgaagtaacaaatattgacgcggttttcgatgttctccggctggttcagtgccagcacgttcagcggggtgttgctcttcagcaactcttcaacgttatttttcagcaacggaccgaccacaatactcgcgccatcctgttgaacctggcttaagatctggctaagtggttgtgatgatgtatcgtagattttcagctctgcggatggattcgcgggtgcgcttaccgctgcggtggttgccgccggggcgcttacaggcaccggctgggccgcaggttgttcaccggtcagatcgctaaccgaggcttgtgccgggctggcaacgccatccacggtttgcggctgaggttgttctgctacgtctgcggcaggtgcggcagctacctgagccgccactggctgagtgccgatatttttcgccgcttcaaagccttgctgaatagtgcgaccaaataccgctgcctggccattcagtggcaacatcagggcgattttgttggtcgatgcgggtttaaacgcttttacgttaaccaactgcgttggcagcattttcgcgcccgggttgttcggataacgtttctgccagtcggcgatcccggctttcatcatgtcgggatcgttacggttatcaaaccagacgcgctgcagatccagccagccttgcagaatattttcgtcggcattgatcaccagcgtattcgcctgttcctgagtcatggaggagagcgcctgccaggtggcgtcaatattctgctgcttttctttcgcaccgagcagcggttcctgagcaattaacgcgcgcagtaaatcaatggaaggacgcccctggctggcatcgatttttgcctgccagtaacgcgcttgctggttttgttctaaatctgcaggtgtgattttcgccagcaagttttgcgcgccagcaaaatctttctgcgccagtttaatctctgccgccagcagtgttttctcgcgacgctgagaatcgttcagttcttgcggtagttggttaaacaactccaccgcctgtccggttttaccttctttcaccagtgcacgaatggcgagtaattgccagttgatcctggtatcatcagaactttgctgcatctgttgcaggtaaaaggcagaatcagcctgcgccgtgccctgcatataagcagtggactgatcgggagtatgggtgccacaaccggcgaaaatcagggctgccagaacaacaggcagacaacgcgcggctttcaaacgagaaaatgttgagggtaccataatgtatccagtgatattttttttacgcaatgctcaatattaaatcggcaatacggacgacacaatgaaacaacaccaatcggcggataattctcagggccagctttacattgtaccgacgccaatcggcaatctggcggatatcacccagcgtgcgttggaggtattacaggccgttgatctgattgccgccgaggatacgcgtcacaccggtttattgctgcaacattttgggattaatgctcggttgtttgcgctgcacgaccataacgaacaacaaaaagccgaaacgctgctggcgaagctgcaagaggggcaaaacattgcgctggtttccgatgccggaacgccgctaattaacgatcctggctaccatctggtgcgtacctgccgtgaagcggggattcgcgtggtgccgctacccgggccgtgtgctgctatcactgcgttaagcgccgcgggtttaccatccgatcgtttttgttatgaaggctttttacctgccaaatcaaaaggccgccgtgatgcgctaaaagccattgaagcggagccgcgcacgctgattttttatgaatctacccaccgtctgttagatagcctggaagatatcgttgcggtattaggcgaatcccgctacgtggttctggcgcgtgagctaaccaaaacctgggaaaccattcacggcgcgcccgttggcgagctgctggcgtgggtcaaagaagatgaaaaccgtcgcaaaggcgaaatggtactgattgtcgaaggccataaagcgcaggaagatgacctgcctgctgatgccctgcgcacgctggcgctgctacaggcagaactgccgctgaaaaaagcggcggcgctggccgcagaaattcacggcgtgaagaaaaatgcgctgtataagtatgcgctggagcagcagggagagtgattacaggcgtcgcagcaggaatagcgctacaacgcctttacctggcgagttaacgacgacacatttcatcaatcacgcatgtgaaatggttatgcagccataaaaatgaagccgggatagcggtagagactttagccgtgagaaaacgttctgtcgcatcctgctttccttcgccagtcaccagtaacaaaacttcgcgggcattgagaatatccttcaggcctaaggtgatcccacgagtcacaggacggcccgcggtttttaacatctcatgttgctgtgttctggcatcaagttgactgatatggcaggccggttgcaggttttctcccggttcgttcagcccaagatgaccgtttttccccaatccgagaacgcataaatccagaccgcctttgcgcgcaatcaggttcgttacccgttcgcactctgtctcatttatctcttcggagcgaaagctgatgagttggtcttcacgtagccccagcggctgcacgatatgctgttgcaggaaagtttcgcaggtgccaggcatcgttaatggcagatccacccattcgtcgagcttcacgaaggtgagctggctgacatcaacctgctgctggtggattttttctaccagataatgatacgtcagtaatggcgtggctccggtcgccaggcaaatcacggcatccggtttgctacggatcacggccaataaatattcgctggcacgttcacttaacgccgtatagttttcaacttgttgaagggtttgcacaggatgaaattccttaagtaaagaggcaccgccagacgcggtgcctcgttccatttacaaaatgccgaatgcagaacaaacaatagaaagaacaaacgtcacgccgattaacagcaccggatgcgcttttttcacccgcaggaagtaatacatcagcagggtgtaggccatcggtaaaatattcgggaagactttatcgaagaaatcctgctgcagcgcgacgctgtgggtactgtcgatggcaaacgatgtcaccacgttaatatgcacatacgaagcgatcagcccgccgattaccgtgatcccgaggatggttgccgaacgagcaatcatctgcgagttctctcgcactttatcgatcgccttcacgccgactgaataaccgacgtgggtccagccgacgcgcaggaagaagataagcaggtaaacggcgaaaaatagaatcggccccagcaagtttccctggctggcaaatgatgagcaaattcccgccataatcggcaataaggtaaaccagaaaatcgcatcgccaatcccggcgattgggccaaacagtgccactttgaggcctttaatggtgtcgcggttttctcctttttcttccatcgaaattaataaccccatcaggaatccgaccagattcgggtgggtattaataaattcgaggttatctttcatcgccgcgcttaggcccggtttgtcgtccttataaatctttttcaggatcggcaacatcgcccaggtaaaaccgcccgcctgcatcctttcgtagttaaagcttgcttgtagcagtgacgaacgaaagcccagacgggtgatatcttttttactgatttcagatcccattgctgtagtcctcttcttcatttttactggcaacgggctgcggttgcgcttgctgccgggatttcgcattgaaaaactcatacaccgcaaagcctgcgcccagtacggcaaccggcaacaggttgctgacctggatgtagcaaacaaacaggaaaccggcgatcaggtaagggatatattgcgctttgaacattacgcgcagcagcaagccaaaaccaacggcaggcagaataccgccagccacttcaaagccgtgggtcagccaggcgggcatcgctttcaccagcgcctgcatcgccccttgtgccaggtaagtacagaggaaagcaatcaccgcatacgctgaagcgacgatgagcatcgttgtccagttaagtcgggaaaacgctgccgtatccgcttctttcgcgcatttatcggctttggtcataaataatgagaaagcggaatagaagaacagaatgacgtactgcattaacaaactaaacggcaggccaagaccaattgccgttttggcatcaacgcccgtagaccatgcaatgacggtggtcatcagacccgccataatcgggttgggcggctgaacaccacctgcaggggttaatccggcgaaagccaactctgtcagaccaccggtaattaagccagtctgaatatcaccgagaatagcgccagttagggtacaaacgattatcgggcggaataaaaataaggcttccagccaaaaatcaatccccagaaagaaaactaacgccgccagggataatccttggagtagggttatttcatgcatttttattacctcaaaccaatattaaggcgattttagatttagtcagggatttgttctttttgatcgccagggacgtcctgaatgaaaacattcacgccacgttgtttaataaaacgtaagtccgtgagatcctggtcatcgacataaactttactgctgatttgctttttcccttccgagaaatgcatattgccgacgttgacatctttcaggtcaatgccaccttctaccaatttacgtaccgtttgtggcgtacggcaaatcaggaagatcttttgatgcggtgcagctttgccgatgacattaatggttttttcgatagtaaagaaacgaatgccaaagccgtaggtttccgcggtaatacccattaatttctgttgaatatcatcgttagcgacaacatcatccacgactaccagcagatttgcaccgatggtagatgtccaggtcacgccaacctgaccgtgaaccagacggttatcaatacgggttaagagaatatttggactgctcattgtgtaatcctcaccataaagttgaataatataatttttttaaatatattattgttgcgatattgtactgatgtatttattaaggtttagttatctcctttaccattaaggcactccccgatattaatcgggaagtacattgggataaatcataaaaaactaatgattatgctgaaattcgattcgctgaaccacagacattaattttatttctgacaacttctttcatcgcatccataccgacgcgcatataataacgaggatcattaccctgcggattttccgcaaaccaggctttaaccgcgccagcgaaggctatttttaattctgtggcaacgttcacttttgtgacgccaagttcaatagtgcgacggacaaattcatccggaacatcgctggcaccatgcagcaccagaggaacatccaccacttcacgaatttccgccagccgctggaaatcaatcttcggcgttttgctgtataagccgtgcgccgtaccaatcgctaccgccaggctgtcgacgccagtcagttcgacaaagcgtttagcttcttgtggatcggtcaggaatgcactttcggcgtcaacgctcatgtcatcttcaacaccgcccaggcggcccagttctgcttccacgctgcaatcctgtgagtggcagaagtcgacaaccgatttcaccagcttcacgttctcgtcaaacgggaagtggctgccgtcgatcatcgcactgcgcacgcctgcgtggactttacggcgaatatcatccagcgattcgtggtggtcgagatgcagcgccagtggcatgttgtaggttgtggaataggcactacacagggcgtagatctcttccagcgcgatatgtttaaaggtccccggcgttccggcgaggatcaccggcgatcgcatttcactgcacacttcgaggatcgcctggatcgtctcggcgttatgaatgttaaaagcaggcaccgcgtagccattggcctgggcgtcctgtaacagatatttggtggagataatgctcataatgcgatcctcttatgcctgccacggatgaatgattacgccttgcaccacgcggttaacggtgccgctggctgatggggtatccggcgtattgcccatgtgcagcgactgcataagtgcaaacgtctgggcgtacatcaggaagcaaaatgcctgctcaacgtcgataaagtgacgggacggcggcaggataatatgtggaccggcagcaacgatgtctgtgctttccgcggcgatggcgattacgcgcattgcctggttatcgcggcgaagttcagccagtagatcaagatcatactgacgggtgtaagggtggctggagacaaataccaccaccagcgtttcgttatcgaccagcgatttcgggccatgacggaatccggtcggggaatcataaaaggccgccagtttacccgccgtcagttccagtactttcagcgccgactcgcgtgctgcgccctgtaagccaccgctgccgagataaacgatccgtttccacggtgcgtaaccaaacacaccttcgctgaaatcgcccagtgaggtcaggatcgcctggcaacgatccgccacgtcgcggaagctctggctgttgatcgtctcaggtgcgaaaaccgcgaggcagctgaccatcatggtggtaatgctgctggtcatcgcaaagccgcggtcgtgcgtttctgcgggcatcagcagggcaaacgcgttgtcgctgttgatcgcgttttggtaaagagcgcccgcttcgttgcaggtgatcggcaggtgatagcactcgggtacaaattgatttgccagttccacggcggcgacgctttccgggctgttgccggatcgaccgaaggagatcaacagcagtggatgagctggattcaggtagtccatcggattggtgaccagatcggtggtcggtacggcgctgaagtttttacctgtatggctggcgagccacggcgcgatgatgtcaccgataaatgccgaggttccggctccggtcaggattacccgcagattctctttgcgcagtaacggttcaaggaagttattgagcgcggaacgtagcgcgtcgatgttggtgagtgaacggatccatgcgcgaggctgatggcggatctcttcttcagtccatgtaccggttgcggcagcagcaggggtgtaattttctggcataactcaatccttagtctgatgaacttgacgtcgggcgttgtcgctttcgcttacctttcgtttcatttcacttggtgatgtctttcgttgattaaaatctatagaaaagaaactgaaagttcaatggagaaaaaagaaataaaacgaaatttgtgatcgttgaaagaaaagacaagggaagattaaaggatggcgtgatgacgttgctatgttcaccgattgccggatgcggcgtaccgtaggtcaaagaagacgcgtcagcgtcgcatccgataccctgcacagagcacaacgaaagaaaaagaaaggccttacgggggaagtgaaggcccaataaaggagcaaaccatcaaaacgaagctaattgaccctgaatccagatttgttgcacatgcagcccgctatccagcgcaacgatgctggcgcgtttgcccggtttaagcgatcccagaacatcatcaacacccagcatttgcgccggatgcagcgacgccatatggatggcttcggcaggcgttacacccgccaactcaaccatgttgcgcactgccgcatcgacagacagcgtactgcccgccagcccaccggacgcggtacggacaacgccaccgtgcatctgcacttcttcaccacataacgtatagcgaccatccggcatccctgctgcctgcatcgcgtcggtgatgagcacgattctctcttttgcacagcaacaacacagcgacatcgccgccggatgcacatgatgaccatcggctatcagttccagccaggcgcgcttgtccgttaatcccgcgccaaccattcccggttcgcggtgatgtaaacctgtcatcccgttatagcaatgcaccaggccgtcggcaccagcgtcaaacgcggcacgggtttgttgccaggtcgccgcgctatgccccagcatcacccgtacgttttgctgtttaagatggcggatggcctgcaatgccccttctttttccggtgccagcgctaccacgcgcaaggtgtgctgagaaacggcaatcaactgatccagctcggcaatttccagctcgcgaaacagctccggcggatgcgcgcctttattctgcggcgtgaagtatggtccttcgagataactccccagcacttgcgcaccaggtccgccgcgttggcaacgttgagcaatacgtttcagcgccgcatgaatggtattaagcggcgcggttacggtggtcggtaaccaactgccgacaccttcgcgtgccttgtgcattgccagcttgtcgagcacatccggcgcgtcatccattacatcaacgcccgcaccaccgtgtacatgggtgtcgatgtaagcggggcagagcagttccgcatcgcgttcagtcacgcccactggaatcggttcgattgctgcgattacaccgtcagcaatacgcaactgatggtcatcgagccatccctcttcagtcagcagccttctggcgcgcagaacgtgtgtcatattccttcctcgaccggacattcttcatggcagcggcctaactcgtccaccaaactggtcagcccacggtgtccacactccagcgcctgcacacggaactcttcaccgcttaacccttcgcgctccagcaccatctccagtagcagttgcaaattggtgccggtgatcacttcacagcccggtttttgcatcgccagcgttgaagctacgcgaaacggcgtgccgcccagcaaatctgtcagaaaaacaatgccgtcttcacaatccagttgggcgaaggcctcttcaagctgcgatgtaagcagcgcggtgcttgaggtttccggaaaatcgatggcgataaactgcgattgctcgccgaggatttgcttcattgctttttccatgccgctggcaaatccgccatgccctgtcaaaataatacttaacatctaatacctcattgtatttaaaggaaatgacagaatttaccgacgataccgagaaccacggtaactgcaatcaggcgcagcggactccagccgcggcgtaccagccagaacatggtcagggtgtagaccagcggtaagaaggcaggcatcagtttgtcgataacatcagcctgtaacttaaccactgcatcgccagcggtgatttccagcgtggtgcttaaacgaacataggttgctaccagcgcgccgattaccgtcatcccaacgattgacgcagcatggccgacttttttggtattcgctttaatgagtggaatcgccgccacgcccatgcgataagcataatgcgccagaccaaaacgcagccccaggtgtaccacgttgaacagcacaataaagacgacagcgccaagaatagagccttgtagcgcgaggcttgcaccaatcccgccacaaatcggcagtagcgtcagccagaacattgcatcgccaatcccgccgagcggcgcaccgacggcaattttggtgctctgaatactgttaacgtcctgcttagaacgctccatcgcaaggataatgccgataacaaacgtcaccagaaacggatgggtattgaagaaacccatatgccccttcatggcgcgcgccaggtcgcgtttattagtgtggatctttttcagagcaggcagcagaccgtacaaccagccggaagcctgcatacgttcgtagttaaaagacgcttgtaacagcatggaacgccaggcgacgcggttgatatctttttttgtcagctctgcgccaatgctctgatcttcatacacgttttcattgacgccagtcagcagtgtttcttcgttttcactgacgttcggcagggtggtttgattagatgccatcttcaaattcctctttctgtgccgcaggttgagtcggttcaggagatttacgcagcaggtcgatcagcgccatcgccagcgcggcggcagcaatagccagcaccggtaacttgagccaggctgcggcaacaaagcccaggatgaagtaggggatgtagacgtttttcatcatgattttcagcagcacggcaaaaccgattgctggcatgatgccgcccgcgacgccgaggccgtcgattaatcgttgcggcaggacatcaatgatggtttttgcatgttccgcgccgaagtagataggcaggaaagcgcagagaaaatagaaagtgccgagtgccagcagtgccagatagttcacgcgttcaatgccgcgagtatcggcgttctccgccatccggtcgcagcgggacattacgccagacatcaccgagaacaggaaggtaatccccatctgtactgcgacagcgaaaggtacggcgacaccgaccgcgacatcgggtttcacgccagtagtaatggcaaacgccgtgccgacgatagtaccgataatcacgttaggcggttgtgcgcctgccagcggggccagccccatccacaccagttccagcgtaccgccggttaaaataccggtatgcagatcgccaagtaccagcccgactaacgggccgaggaccaccgggcggtgcatatgggttaagccgttaaacatatccaggccagcgataaaggcgataatgcccaacgcgaatgcctgcaacagactgatttccatgatgaatccctcaaagtaatttaaagaggtccacagcaggctctgtcgggacgccctgaacgaagcattccaccccagcggctttcaggtcgttaaatgctgcgatatcgcccgcatccacagaaaccgttttggcgatttgttgcttgccattggcgtagtgcatattgccaacgttaatgcgattcaccggaacgccacctttcaccagcgtcaggaaatcggcaggtgttttacaaaccagcaggattttctgtcgatcggcggcgcggtggatgttgtcgataactttttgcagcgtccagaaacgtacggcgatcccttctgccagtaccatttccatcaggttttgttgtaccggatcttcggcaacctcatcgttggctaccagcaccagatttgcccccgcaaatccgacccactgaacgccgacctgaccgtgaatcaaacgctcatcaatccggcttaaaacaatatttggcatagcgtgttcctctttgttttgcttattggccttcacaggctgtgtggtactgcgccaggatgtcctgaatatggttgataatgagttcccgtggtgttggctgcagctcgccggagcgaactttcacgtattgcagcggcaaatactggctgatgagcggtagcggaattggtgaatccgccagattacgaaccagatgagcgaaagcgtcatcaatctggctgtccggccagtaatagcgcacgcgatccgagtagctataaccacgcgccagacgacgcgcgttgccgtcaccgtggtagtggctttgccagtattccgggcggtcgagcatcacgttttccagcacctgacgcagaccagaacaggcttttgctggcaccagttcttcttcaatcgctgccagagagaacagagcttcacgcagggcgaaggtcagcgccgggccaactttcagaatggcaaagtggtcaatcactagctggcgcaacgattgcggcgtttggtaatcggtagagtgcgcttcgaaaatcagcgtttcgtagttttcgaccatctggcttaaggcggtcgctttgacgggctgataatcaataacgttggtgtgatcgaattcgacgccgggttgaaccaccagagcaatgatgcgtggccagatggcactcagaccttgcttttcaaaggcgtgacgatgggcttccagcgtggcgcgggcggcatccggcgtggtgaccgccagctcgcttaaggtttcatgcgcgccgccaggtaccggtacttcggtaccaatgacatacaccagatcggcttcgccaaagtgttcacgacaggtttcttccgccactttcgccagacgtgcggcgcgttcagccacgatgtcatcagttaagggaaccggatcgtcctgacaggacatgctgcaatcaaggtgaatttttttgaatcctgccgccacgtagcttttaatcaaatcatcggcattggccattgcctgagcggcaggcaggttttgccagcgatttggacccagatggtcgccacccagaatcaacgcatcctgtgggaaattcaacgagtcggcgagctgacaaacaaagccgcgaaaatcggcgggcgtcattccggtataaccgccgaactggtccacctgattggaggtcgcttcaatcagtaacggcgtttggtttgcactggcgtagcggattgcagcttccagcaccagcggatgtgcggaacaaacggcataaatcccatttgttttgcccgctttgtgctgtctcaccatttctgtcagatgtttcactttcctctccagttcagattactgcgatattaatctttcgttttgtttcagttgatactgcgccatggtgagataaaaataaaacgaaagataatagttttctgatctgattcacaaaagaaacataatgaaagccactgaaacgagagtagcttgcgccaatgggtaaggtgggcttgcatttgcttaatagaaaggcgttaataggcaaaacgaaatgaaacgaaagttttacgaaaggacttactatgagtaataccgacgcttcaggtgagaagcgaatgacaggcaccagcgagcgacgagaacagatcattcagcgtctgcgacagcaagggagtgtgcaggttaacgatctgtcggcattgtatggcgtatctactgtgacgatccgcaacgatctggcgtttctggaaaagcaggggatcgctgtgcgtgcctatggcggcgcgttgatctgcgatagcaccacgccgtcagtcgagccatcagtggaagataaaagcgcgctgaacaccgcgatgaaacgcagcgttgcgaaagctgccgttgagttgattcagccaggtcatcgggtgatcctcgattccgggaccaccacttttgagattgctcgtctgatgcgcaagcacactgacgtaattgcgatgaccaacggtatgaacgtggctaatgcgttgctggaagcggaaggcgttgagctgctgatgaccggcgggcatttgcgccgtcagtcgcaatctttttacggcgatcaggctgaacaatcgctgcaaaattaccacttcgatatgctgtttcttggcgtagatgcgatcgatctggagcgcggcgtcagtacgcataatgaagatgaagcccgtttaaaccgccggatgtgcgaagttgcggaacggatcatcgtggtcaccgattccagtaagttcaatcgttccagtttacataagatcattgatactcaacgtatcgacatgatcattgttgatgaaggcattcctgcggatagtctggaaggcctgcgaaaggctggggttgaagtgattctggtcggggagtgagaaagggtgcccgctggtcaacacgaatgcgttcggcgggcattgtgaacaccatcaatgggtttcttctgcctctcgggtgagggtttcccagtcggcaggaggatgtcctctttttaacattttgctgaatacggtataagcatctgtttttttaccgtaggtgcgcagagtgttttcatcgttcatccatcccagaatgatgactttctctttttcactataacgaaagaagagacgataacgaccagcaccaaattttacccgtgaccagtctttatttttcccagagcctaacgacttgccatgacggaatgccggtgatgatggattgaccgtgatatgctcctcaatcactttatggactaccgccaataactttgtggcggcttttctctgataattttcaggatcttttccctttaatgtctcgacttcggcaactaaagcgtcgtaggtttcctgaaaacagggatgagcatatagcgcccaaccattaaccctttgtggaaaatccattattcgtcgtcgccaatctcatcatcaatgttgacgtccatgccagcgacaagtttctttccttgttgaatgttgaatggacgagttttttgcggggtgttctggatatctgcatccagaaaacgcaaaaatgcattcatagtatgatcctcctgttcatctcccagtcggcacataaatacttgcccaccaggcagaatttcgtaatgaatgctgtcctggcctggcttcagttttaaggcctcacgcactggcgcggggatagttgtttgtccgcgtatcgtgacctttgattcagtggtcagtacagcgtgagagcgagcattagcgggcatgattcactgtccttttacagcctgttttctgctcaaattataagcttgaactaaggtaatgcaaatgcattattaatggacgtggggactttaaacaataaaaacatggcactaaggccatgttttgcgagggacgttccaaaagaaatcaggtcaccggtgccgggttaaacaccgccagctggttatgcagtccccattgatctgagaaggttttcttcttcccgctggcgacgtcgagaataaagtggaacaacttccagcccacctcttcaatagtttcttcgccggtagcgatggtgcccgcattaatatccattaaatcaaaccagcggttcgccagctcggtgcgggtcgccattttaatgacgggtaccgccatcaggccgtacggcgtaccgcgaccggtcgtaaacacttgcacggtaatccctgaagccacctgttgtgtgccacagacaaaatcactggctggcgtcgcggcgtaaattaatccgcgtttagtcgggcgttgaccgggcgacagcacttcaacaattgcacttttacccgatttagcaatggagccgagcgctttctccaccacgtttgccagaccgcctttcttgttgcccggcgaagggttggcgctgcggtcggtttttcccatattgagatagttatcgtaccactccatctcctccagcagccgtttgccgacctcttcgttcactgcgcgtggtgtcagcagatggatcgcgtcacgcacttccgtgacttctgaaaacatcaccgttgcgccgcagcgcaccagtagatcagacgcatacccaaccgccgggtttgccgttacgccagaaaacgcatcgctaccgccgcactgcatgccgacaaccagttctgaagccggacaggtttctcgctgccgttgattcagtttgtgcaaatggcgttcggcgacctgcaaaatatcctcgaccatggactgaaaaccgacatgcttttcatcctgcaaactgacaatgctggcgctttctactggaatagcttgcacatcatccgttccagtcagcaggcgttcaggctgcaacttttcacaacccagaccaatcaccattacttcgccgccaaagttagggttcagcgaaatattgtgaatggtacgaataggcacaactgccgccggtgcgttaatcgccacgccacaaccgtacaaatgattcagccccaccacgccatcgacgttcgggtatttcggtagcagatcgcgttcaatgatttttactacatagtccaccacgcctgccacacagtggacgctggtggtgatgccgagcaggtttttggtgcccacgctgccatcggcattgcgatagccctcaaaggtgtatccttccagtggcggtaagggggccgggactttggttgccagtggcagcgtgtgtaacggcggcgcttccggtagtacaaccattgattcgtcgatccagcttccgcgtgggattgcgcgcacggcgtaaccaatcacttcgccataacgaataatttcaccattagccggaatgtccagcaatgcgactttatgcccctggggaatatgttcaattaattccagcccatccggaaaacgcgttcctgctttcaggccattatcattaacaataattgccacattatctgtgtcgtgaacttttatataaaacgcagttggcgtttcttgtctgatttcgatgttggccattgtgcaatattctccagccaggggttattaaaatgaggacctggtctcatttaaaaataaatgacttcattgggtgaaataagaatgtcaggagtttaaacgcagaaatgtgatcaatgtcaatcatttcagggattgcagtgccgcacggtaaggtaaagcgcaaatctgtgctttagcgcgcaaccttatgtgcatatgctcaaaataatatttaaatagtattaattaaattagcatttgcacaatgattattattctcgcgctgcttatactaattcccgagttcattgccgtaacggcataaataaaactcataaataacaccttccccataataataaaaatcagcataagtacccgaggtaaataaaatgattctggacaccgttgacgtaaaaaagaaaggcgtgcatacccgctatttaatattactgattatttttattgttaccgccgttaactacgccgatcgtgcaacgctgtctattgctggtaccgaagtggcaaaagagttgcagttaagtgcggtttcgatgggttacatcttctccgcttttggctgggcctacctgctgatgcaaatccccggcggctggttgcttgataagtttggctcgaaaaaagtttacacctacagcctctttttctggtcgctgttcaccttcctgcaaggctttgttgatatgttcccgttggcctgggcagggatctccatgttctttatgcgctttatgctggggttctcggaagcgccatcattcccggcgaacgcccgtattgtcgccgcctggttcccgacgaaagaacgtggtactgcctccgccatctttaactcggcgcaatatttctcgctggcgctcttttcgccgctgcttggctggctgactttcgcctggggctgggagcacgtctttaccgttatgggggtaattggttttgtgctgacggcgctgtggatcaagttgattcataacccgacagatcacccacgtatgtctgcggaagagctgaagtttatctcagaaaatggcgcggtggtcgatatggaccataaaaagccgggcagtgcggcagcaagcggtcccaaactgcattacatcaagcaattgctctctaaccgcatgatgctgggcgtatttttcggacaatattttatcaacaccatcacctggtttttcctcacctggttcccaatttatctggtgcaggaaaaaggcatgtcgattctgaaagtgggtctggtcgcctcgattccggcactgtgtggctttgcgggcggcgtgctgggaggtgtcttctcggattatctgatcaaacgcggtttgtccctgaccctggcacgtaagctaccgattgtgctgggaatgttgctggcttccaccatcatcttatgtaactacaccaacaacaccacgctggtggtcatgctgatggcgctggctttctttggcaaaggatttggtgcgctgggctggccggtaatttctgacaccgcgccgaaagagattgttggcctctgcggcggcgtctttaacgtctttggcaatgttgcctccattgtcactccactggtgattggctatctggtaagtgaactgcactccttcaatgcagcactggttttcgtgggatgttcagcgctgatggcgatggtctgctacctctttgtagttggcgacattaaacgtatggaattgcagaaataagcaaaggtataagcgatgaataacgatgttttcccgaataaattcaaagccgcactggctgcgaaacaggtacaaattggttgctggtcagcactctctaacccgattagcactgaagttcttggtttggctgggtttgactggctggtgctggatggcgaacatgcgccaaacgatatctccacgtttattccgcagttaatggccctgaaaggcagcgccagcgcgccagtagtgcgagtgccgaccaacgagccggtaattattaagcgtcttctggatatcggtttctataacttcctgattccttttgtagaaacaaaagaggaagcagagcaggcggtggcatcaacccgttacccaccggaaggcattcgcggcgtctccgtttctcaccgcgccaatatgtttggcaccgtggcggattatttcgctcagtcgaacaagaacatcaccattctggtccagatagaaagtcagcagggcgtagataacgtcgatgccattgccgctaccgaaggcgtagacggtatcttcgtcggccccagcgatctggctgcggcattaggccatctcggcaatgcctcgcacccggatgtacaaaaagcaattcagcatatttttaaccgtgccagtgcgcacggcaaacccagcggtatcctcgcaccggtcgaagccgatgcgcgtcgttatctggaatggggtgcgacgtttgtggctgtcggcagcgatctcggcgtcttccgctctgccactcagaaactggctgatacctttaaaaaataaccaccaccgcaacaagagagatgattgatatgactatgaaagttggttttattggcctggggattatgggtaaaccaatgagtaaaaaccttctgaaagcaggttactcgctggtggttgctgaccgtaacccagaagctattgctgacgtgattgctgcaggtgcagaaacagcctctacggctaaagcgatcgctgaacagtgcgacgtcatcataaccatgctaccaaactcccctcatgtgaaagaggtggcgctgggtgagaatggcattattgaaggcgcgaagccaggtacggtattgatcgatatgagttctatcgcaccgctggcaagccgtgaaatcagcgaagcgctgaaagcgaaaggcattgatatgctggatgctccggtgagcggcggtgaaccgaaagctatcgacggtacgctgtcagtgatggtgggcggcgacaaggctattttcgacaaatactatgatttgatgaaagcgatggcgggttccgtggtgcataccggggaaatcggtgcaggtaacgtcaccaaactggcaaatcaggtcattgtggcgctgaatattgccgcgatgtcagaagcgttaacgctggcaaccaaagcgggcgttaacccggatttggtgtatcaggcaattcgcggtggactggcgggcagtaccgtgctggatgccaaagcgccgatggtgatggaccgcaacttcaagccgggcttccgtattgatctgcatattaaggatctggcaaatgcgctggatacttcccacggcgtcggcgcgcaactgccgctcacagctgcggttatggagatgatgcaggcagtgcgagcagatggtttaggaacggcagatcatagcgccctggcgtgctactacgaaaaactggcgaaagtcgaagttactcgttaatgacgtcgtgcccggatggcgtattgcaatccgggcctggaatccaggccgaataagagaaacgccctccggcgtcatgtggtaacaggcataggtatgaaaatcgtaatcgccccagactcttataaagaaagtttatctgccagcgaggttgcgcaggcgatagaaaaaggatttcgggaaatttttcctgatgcacagtacgtttctgttccggttgccgacggtggcgaaggaacggtggaagcgatgattgcagccacccagggttccgaacgtcacgcctgggttacagggccgctgggcgagaaggtgaatgccagttgggggatctccggcgatggcaaaaccgcgtttattgaaatggcggcggccagtgggctggagctggtacctgcggaaaaacgcgatccactcgtgaccacttcacgtggcacaggcgagttaatcctgcaggcgctggagagcggcgcgacaaacattattatcggcattggcggtagcgctacaaatgatggcggtgcaggcatggtacaggcgctgggggcgaaattatgcgacgccaacggcaatgaaattggttttggcggcggtagtcttaatactctgaatgatattgatatttccggcctcgatccgcgcttaaaagattgcgtcattcgcgtcgcttgtgatgtcaccaatccgctggtgggcgataacggtgcatcgcgcatctttggcccacaaaagggagccagtgaagcgatgattgttgagctggacaataacctctctcactatgccgatgtcattaaaaaagcgctgcatgttgatgtgaaagatgtccccggcgcaggagctgcgggtggtatgggcgcggcgctaatggcgtttcttggtgcggaactgaaaagtggtattgaaatcgtcactacggcgctgaatctggaggaacatattcacgattgtacactggtgatcaccggtgaagggcgtattgacagccagagtattcacggcaaggttccgattggcgtcgcaaacgtggcgaaaaagtaccataaaccggtgattggcattgcgggtagcctgaccaatgatgttggcgttgtacatcagcatggcattgatgcggtcttcagcgtattgaccagtattggtacgttggacgaagcattccgcggggcttatgacaatatttaccgtgcttcacgtaatatcgccgcgacactggcgattggaatgcgcaacgtggggtgacaagggcgcgcaaaccctctatactgcgcgccgaagctgaccagacagtcgccgcttcgtcgtcgtcctcttcgggggagacgggcggaggggaggaaagtccgggctccatagggcagggtgccaggtaacgcctgggggggaaacccacgaccagtgcaacagagagcaaaccgccgatggcccgcgcaagcgggatcaggtaagggtgaaagggtgcggtaagagcgcaccgcgcggctggtaacagtccgtggcacggtaaactccacccggagcaaggccaaataggggttcataaggtacggcccgtactgaacccgggtaggctgcttgagccagtgagcgattgctggcctagatgaatgactgtccacgacagaacccggcttatcggtcagtttcacctgatttacgtaaaaacccgcttcggcgggtttttgctttttggagcatagtgtaagatgaataaatatctacggtattaataatagactttgtaagaaattattaagtctatattgcatttaaaaggtcgtaatcatacgtatagtcctctctggtaaaatattgcttctctgagttataagcttcatatgtgttatattttacgacctcaaagccattgtctggagaattttcgtctttctcgagtgtattatctggaaggaattcctctgagctagagtcctctatgtttaaatctgtattgtaattaatgtttggatcgatcagataagcatttcctttgacgctttcataatctttaatgattatatcgatgtaataatctattttttctgatgagaatgctttcatctctggcaatttaattctgctcaagtaattgttaattttcgatgagcttttatatatttcttttgttaattcattttctaattgatctgttagagttgctcttggtatagattctataattgcaagcctcataatttttaattgttcttcggtaatatctccaagcgcatttaaacaactttcgacaagcttaattttttcttcagaatacatatcgttaatgcttgttataacaggcgttatttttagcaaataatcccatgagattgtggcgttttgttttgagctaacgaaatttacctgaaacatgttggcattagtaaaatctgtgtcatccaatttaaaaggatttaaaattgtattggccatatgtttatctgtaaaatcataaagttctaaatcgacattccgtaagtccagagaggatagatcaactatacctccagtcccacaactaaagattacgttcaatctcctgatttcattgtaaatgtctttcaatgggcaattaacattgatattgcctgtggatatttcctggttttttaacggttcattaattgtaagttcacaggtattgtctgatcgttgaataattcgggcgttataaccaaaaaaatccatacgaagagacgaatcattataaagaattacattttgtaagtacgctaattctttttgaaaatcaccagtgataacacatttcccacctggttgtaacgcgttaagtaaagtgaccatttcaatagaggtccgttttagtttttctattcctggtgctagtgcttcgaggttatttcctatggggctttcaggaagatcattcatttttcgacgggctaaatcactactaatatcattaccaattgatgaaacaggggacattattttatcctttataaataatcaataaaaatcattattaaaatgatcgggtgaaaaaaagagaatttgccaacaatctgaaggaatggaggttttattaaagtacgtagggggggttaagatggcttcttttcgggtgaattttgcacaatacttagaaatcgtctccttaatacactccagctcttttttattgacggctgagcaagtacattgttcgccaaaaggtgcaaaagtgcctacatctaatgtttgtatgatataatcgtcatgttctcctgtagaaatatctatgatgaatggactcatattttccggttggattcgaatcatgacagaaggaacatcgccttgatagaaattcaatgcagtaattgcagataatactctccgcagttcattacttatactgtatattttattaacgtcattggtggagacaatttctgcaaactttctttttaccgtccaataatcaatatttctgttgtgattgttaaccactgcgtgcattggcgggattgaagggtgaaaaatatgtgcaattgggaagcctttcattgatgcctgccttgtcatcatgacaaacaataatagatgcttattttcctcgcagggttctttcgcactatcaaaaaacgctcatttatccggcgttacagtaaacgaagcaacattctgtggcctacgccgatcaaaagctctgtgaaaattccccttgttgtctttggctgaccttatcgcggcgaccagcaattattcgttttgtgatcctcaacacaaaatgctattcgtcacctatgaggggagaagaatttatggaaaacgattgcattcacaaaatgacgtcctgtcatgagggagaaagttgacgttaatcaattgttcgagatgatcaatacctgtattcgaaattttaacatattgataaaataaatgtttgttctccaacaaatagcgtgaaaaaatgtgacgtgccgcattatttatcgctgaaaatgatttatttataataaaatttgagaacttgctcattaaatttaactcaaaatttgcctggtaattatccggtaattgcttgaaatatggtctcagccccttttttgtattaaccacataacgaatgatgttatcgccataaaatatggttatccccgtcattttttttgacaaaaatcagggtttatgctgatttttatactttaacttattgatatataaagatatttaattggaataacgataccatggaaagtattgaaagttaatttgtgagtggtcgcacatatcctgttcatttcattttgatacacttcatgccgtcaatgaggtaattaacgtaggtcgttatgagcactattcttcttccgaaaacgcagcacctggtagtctttcaggaagtcattagaagtggttctatcggctcggctgcaaaagaattagggttaactcaaccggctgtcagtaaaatcattaacgatattgaagattattttggcgtggaattagtggtgcggaaaaataccggtgtaacattaacacctgccggtcaattgttactctcccgttccgaatccattacccgtgaaatgaaaaatatggttaatgagataagcggtatgtcttctgaggcggtggtggaagtctcatttggttttccttcattgattggttttacttttatgtccgggatgatcaacaagttcaaagaggtgttcccgaaagcgcaggtttctatgtatgaagcgcaactgtcttcgttcttaccggcaatccgcgacggtcgactggattttgcgattggtacgttaagcgcagaaatgaagcttcaggatttacatgttgagccgctgttcgagtccgagtttgtgctggtagccagtaagtcccgaacatgcaccggcaccaccacgctggagtcgttgaagaacgaacagtgggtgttgccacaaaccaatatggggtactacagcgagctgctcaccacgttacaaagaaatggcatcagtattgaaaacatcgttaaaaccgactcagtcgtgacaatttataatcttgttctcaatgctgatttcttaactgtaattccttgtgatatgacatcaccttttggttcaaatcaatttattactattccggttgaagaaacattacctgtggcacaatatgccgcggtatggtcgaaaaattatcgtattaaaaaagcagcatcggttttggtggaattagccaaagagtattcatcttataatgggtgtagacgaaggcaattaattgaagttggttagttatttgtttttatttaaacataaataatccacctgtctgttttgcaggtgtcggttacggttacctacatatttaattcaggctaagaggttttataatgcatattacatacgatctcccggttgctattgatgacatcattgaagctaaacaacgactggctgggcgaatttataaaacaggcatgcctcgctccaactattttagtgaacgttgcaaaggtgaaatattcctcaaattcgaaaacatgcagcgtaccggttcatttaaaattcgtggcgcatttaataaattaagttcactgaccgatgcggaaaaacgtaaaggtgtagtggcctgctctgcgggcaaccatgcgcaaggggtttcgctctcctgcgcgatgctgggtatcgacggtaaagtggtgatgccaaaaggcgcgccgaaatccaaagtagcggcaacgtgcgactactccgcagaagtcgttctgcatggtgataacttcaacgacactatcgctaaagtgagcgaaattgtcgaaatggaaggccgtatttttatcccaccttacgatgatccgaaagtgattgctggccagggaacgattggtctggaaattatggaagatctctatgatgtcgataacgtgattgtgccaattggtggtggcggtttaattgctggtattgcggtggcaataaaatctattaacccgaccattcgtgttattggcgtacagtcagaaaacgttcacggcatggcggcttctttccactccggagaaataaccacgcaccgaactaccggcaccctggcggatggttgtgatgtctcccgcccgggtaatttaacttacgaaatcgttcgtgaattagtcgatgacatcgtgctggtcagcgaagatgaaatcagaaacagtatgattgccttaattcagcgcaataaagtcgtcaccgaaggcgcaggcgctctggcatgtgctgcattattaagcggtaaattagaccaatatattcaaaacagaaaaaccgtcagtattatttccggcggcaatatcgatctttctcgcgtctctcaaatcaccggtttcgttgacgcttaattaattcgttgaggataggatatgagtacttcagatagcattgtatccagccagacaaaacaatcgtcctggcgtaaatcagataccacatggacgttaggcttgtttggtacggcaatcggcgccggggtgctgttcttccctatccgcgcaggttttggcggactgatcccgattcttctgatgttggtattggcataccccatcgcattttattgccaccgggcgctggcgcgtctgtgtctttctggctctaacccttccggcaacattacggaaacggtggaagagcattttggtaaaactggcggcgtggttatcacgttcctgtacttcttcgcgatttgcccactgctgtggatttatggcgttactattaccaatacctttatgacgttctgggaaaaccagctcggctttgcaccgctgaatcgcggctttgtggcgctgttcctgttgctgctgatggctttcgtcatctggtttggtaaggatctgatggttaaagtgatgagctacctggtatggccgtttatcgccagtctggtgctgatttctctgtcgctgatcccttactggaactctgcagttatcgaccaggttgacctcggttcgctgtcgttaaccggtcatgacggtatcctgatcactgtctggctggggatttccatcatggttttctcctttaacttctcgccaatcgtctcttccttcgtggtttctaaacgtgaagagtatgagaaagacttcggtcgcgacttcaccgaacgtaaatgttcccaaatcatttctcgtgccagcatgctgatggttgcagtggtgatgttctttgcctttagctgcctgtttacgctgtctccggccaacatggcggaagccaaagcgcagaatattccagtgctttcttatctggctaaccactttgcgtccatgaccggtaccaaaacaacgttcgcgattacactggaatatgcggcttccatcatcgcactcgtggctatcttcaaatctttcttcggtcactatctggggacgctggaaggcttgaatggcctgattctgaagttcggttataaaggtgacaaaaccaaagtgtcgctgggtaaactgaatactctcagcatgatcttcatcatgggctccacctgggttgttgcctacgccaacccgaacatcctcgacctgattgaagccatgggcgcaccgattatcgcatccctgctgtgcctgttgccgatgtatgccatccgtaaagcgccgtctctggcgaaataccgtggtcgtctggataacgtgtttgttaccgtgattggtctgctgaccatcctgaacatcgtatacaaactgttttaatccgtaactcaggatgagaaaagagatgaatgaatttccggttgttttggttattaactgtggttcgtcttcgattaagttttccgtactcgatgccagcgactgtgaagtattaatgtcaggtattgccgacggtattaactcggaaaatgcattcttatccgtaaatgggggagagccagcaccgctggctcaccacagctacgaaggtgcattgaaggcaattgcatttgaactggaaaaacggaatttaaatgacagtgtggccttaattggccaccgcatcgctcacggcggcagtatttttaccgagtccgccattattaccgatgaagtcattgataatatccgtcgcgtttctccactggcacccctgcataattacgccaatttaagtggtattgaatcggcgcagcaattatttccgggcgtaactcaggtagcggtatttgataccagtttccaccagacgatggctccggaagcttatttatacggcctgccgtggaaatattatgaagagttaggtgtacgccgttatggtttccacggcacgtcgcaccgctatgtttcccagcgcgcgcattctttgctgaatctggcggaagatgactccggcctggttgtggcgcatcttggcaatggcgcgtcaatctgcgcagttcgcaacggtcagagtgttgatacctcaatgggaatgacgccgctggaaggcttgatgatgggtacccgcagtggtgatgtcgacttcggggcgatgtcctgggtcgccagccaaaccaaccagagcctgggtgacctggaacgcgtagtgaataaagagtcgggattattaggtatttccggtctttcttcggatttacgtgttctggaaaaagcctggcatgaaggtcacgaacgcgcgcaactggcaattaaaacctttgttcaccgaattgcccgtcatattgccggacacgcagcctcattacgtcgcctggatggaattatattcaccggcggaataggagaaaattcaagtttaattcgtcgtctggtcatggaacatttggctgtattaggcgtagagattgatacagaaatgaataatcgctctaactcctgtggagagcgaattgtttccagtgaaaatgcgcgtgtcatttgcgccgttatcccaaccaacgaagaaaaaatgattgctttggatgccattcatttaggcaaagttaacgcgcccgcagaatttgcataatttagttgaagtattgtagagagattatttttcatgaaggtagatattgataccagcgataagctgtacgccgacgcatggcttggctttaaaggtacggactggaaaaacgaaattaatgtccgcgattttattcaacataactatacaccgtatgaaggcgatgaatctttcctcgctgaagcgacgccagccaccacggaattgtgggaaaaagtgatggaaggcattggtatcgaaaacgcaacccacgcgccggttgatttcgatactaatattgctaccaccattaccgctcatgatgcgggatatattaaccagccgctggaaaaaatagtgggcctgcaaacggatgcgccattaaagcgtgcgctgcatccgttcggtggcattaatatgattaaaagttcattccacgcctatggccgtgaaatggacagtgaatttgaatatctgtttaccgatctgcgtaaaacccataatcagggcgtatttgatgtttactcaccagatatgctgcgctgccgtaaatcgggtgtactgactggtttgccagatggttatggccgtgggcgcattatcggtgactaccgccgcgtggcgctgtatggcatcagttatctggtgcgggaacgcgaactgcaatttgccgatctccagtcccgtctggaaaaaggcgaggatctggaagccactatccgtctgcgtgaggagctggcagagcatcgtcatgcgcttttgcagattcaggaaatggcggcgaaatatggctttgatatctctcgcccggcgcagaatgcacaggaagcggtgcagtggctctacttcgcttatctggcggcagtgaaatcgcaaaatggcggcgcgatgtcgctggggcgcacggcatcgttcctcgatatctacattgagcgcgactttaaagctggcgtactcaatgagcagcaggcacaggaactgatcgatcacttcatcatgaagatccgtatggtacgcttcctgcgtacaccggaatttgattcgctgttctccggcgacccaatctgggcgacggaagtgatcggcgggatggggctggacggtcgtacgctggtgaccaaaaactccttccgctatttgcacaccctgcacactatggggccggcaccggaacctaacctgaccattctttggtcggaagaattaccgattgccttcaaaaaatatgccgcgcaggtgtcgatcgtcacctcttccttgcagtatgaaaacgacgatctgatgcgtactgacttcaacagcgacgattacgcgattgcctgctgcgtcagcccaatggtgattggtaagcaaatgcagttctttggtgcacgcgctaacctggcgaaaacgctgctgtacgcaattaacggcggggtggatgagaagctgaagattcaggtcggtccgaaaacggcaccgctgatggacgacgtgctggattacgacaaagtgatggacagtctcgatcacttcatggactggctggcggtgcagtacatcagcgcgctgaatatcattcactacatgcacgacaagtacagctacgaagcttcgctgatggcgctacacgatcgtgatgtctatcgcaccatggcgtgcggcatcgcgggcctgtcggtggcgacggactccctgtctgctatcaaatatgcccgcgtgaaaccaatccgtgacgaaaacggcctggcggtggatttcgaaatcgacggtgaatatccgcagtacggcaacaacgacgagcgcgtagacagtattgcctgcgacctggttgaacgctttatgaagaaaattaaagcgctgccaacctatcgcaacgccgtccctacccagtcgattctgactatcacttctaacgtggtgtacggccagaaaaccggtaacacgccagacggtcgtcgtgcgggtacaccgttcgcaccgggcgctaacccgatgcacggtcgtgaccgcaaaggtgccgtggcctcattgacgtcggtggcgaaactgccgttcacctacgccaaagacgggatctcgtacaccttctcgatcgtgcctgcggcgctgggcaaagaagatccagtacgtaaaaccaaccttgtcggcctgctggatgggtatttccaccacgaagcggatgtcgaaggcggtcaacacctcaacgtcaacgtaatgaatcgggaaatgctgctggatgccatcgagcacccggaaaaatatcctaacctgacaatccgtgtctctggctacgccgtgcgcttcaacgcactgacccgtgaacagcagcaggatgttatttcacgtacctttacccaggcgctctgacgccggaggatgtatgaaaaagattatcgaaacgcaacgtgccccagacgcaatcggcccttatgttcagggcgttgatttaggcagcatggtcttcacctccggtcaaattccggtttgcccacagaccggtgagatcccggctgatgtgcaagatcaggcgcgtttaagcctcgaaaacgtcaaagcgatcgtggttgctgccgggctgagcgtgggcgatatcatcaagatgaccgtgttcatcaccgatctgaatgattttgccaccatcaacgaagtctataagcagttcttcgatgagcatcaggcgacctacccgacccggagctgtgtacaggtcgcgcgtttgccgaaagatgtgaagctggaaattgaagccatcgcagtacgtagtgcgtaaagcctcgtgagcgggacggtcgcaaggtcgttccgctccacttcactgaacggcaatccgagggtgtggatatgattagtgcattcgatattttcaaaattgggattggtccctccagttcgcataccgtggggccaatgaatgccggaaaaagttttattgatcggctggaaagtagcggcttattaaccgcgacgagccatattgtggtcgatctgtacgggtcgttgtcactgacgggcaaaggccatgccacggatgtcgccatcatcatgggactggcaggaaatagtccgcaggatgttgtcattgatgagatccctgcatttatagagttagtaacgcgcagcgggcggctgccagtggcatctggtgcgcatattgttgattttcctgtagcaaaaaacattatcttccatcccgaaatgttgcctcgccatgagaacggaatgcggatcactgcctggaagggacaggaagcgctattaagtaaaacctattactctgtcggcggcgggtttattgtcgaagaagaacacttcggcctgtcgcacgatgtcgaaacgtccgtaccttacgatttccactcagcaggtgaactgctgaaaatgtgtgattacaacggcctgtctatatctggtctgatgatgcacaacgagctggcgctgcgcagcaaagcggaaattgacgcagggtttgcccgtatctggcaagtgatgcatgacggtattgaacgcgggatgaacactgaaggcgtgctgcctggtccgctcaatgtgccgcgtcgtgccgtagcgctgcgtcgtcagctggtttccagcgataacatctctaacgatccgatgaatgtcatcgactggatcaatatgtacgcgctggcggttagtgaagaaaacgcagctggcgggcgtgtggtaacggcaccgactaacggtgcgtgcggcattattccggcagtgctggcttattacgataagttccgtcgtccggtaaacgagcggtcaattgcccgctattttctggcagcgggggctattggcgcgctgtataaaatgaacgcctccatctctggcgcggaagtcggctgtcagggggagattggcgtggcctgttcaatggcggcggcagggttaactgaactcctgggcggcagtccggcgcaggtgtgcaatgcggcggaaatcgcgatggagcataaccttgggctgacctgcgatccggttgccggacaggtacaaatcccgtgcattgaacgtaatgccattaatgccgtgaaagcagtaaatgccgcacggatggcgatgcgccgcacctcggcaccgcgtgtttcactcgataaagtgatcgagacgatgtatgaaaccggcaaagatatgaacgataaataccgcgaaacatcacgcggaggactggccattaaagtggtctgcggctgacattactgtcagctttcatcattgggtgcacaaatgtgcacctttttttttgtgatctgccgcaaatagagaatgaatattctcttgcgattaatttagtagaaaattcttatccatctccgttatttcaaagtcttgattgtgaagattttctctgacctcgcgcgtatcatttctttattctaataactcgcctgcaaaaacgtagaccgcatatcgccttgatgcggctcggaaaaaaataataagccctacaaaatattgagcgagaaattatggaaattgcatcgaataaaggcgtcattgcagacgcttcgaccccggcgggtcgtgctggaatgagtgagagcgagtggcgagaagcgatcaaattcgacagtactgacaccggctgggtgattatgagtatcgggatggcgattggcgcggggattgtttttctcccggtgcaggtcggtttgatgggattgtgggtatttttgctctcatcggtgattggttacccggcaatgtatctgtttcagcggttgtttattaatacgctggcagaatcaccagaatgtaaagattacccgagcgtcattagcggctatttaggtaaaaactggggcatcctgttaggtgcactctatttcgtaatgctggtgatttggatgttcgtctattccaccgccatcaccaacgatagtgcttcctacctgcataccttcggcgtgacggaagggttgctgtcagacagtcccttttatggtctggtactgatttgcattctggtggcgatctcctcacgcggcgagaaattgttattcaaaatttcgacgggcatggtgctgaccaagctgctggtggtcgcggcgctgggcgtgtcgatggtgggaatgtggcatctgtataacgtcggttcgctaccgccgctggggctgctggtgaaaaacgccattattacgctgccgtttaccctgacgtcgattctgtttatccagacgttaagcccgatggtgatctcttatcgctcgcgggaaaaatcaattgaagtggcgcggcataaagcattgcgggcaatgaatatcgcgtttggcattttgtttgtcaccgtctttttctacgccgtgtcgttcacgctggcgatgggacatgacgaagcggtaaaagcctacgagcagaatatttccgcgttggcgattgccgcacagtttattagcggtgacggcgcagcgtgggtgaaagtggtcagcgtcattctcaatatctttgctgtaatgactgcattctttggcgtctatttaggctttcgcgaagcaacgcaagggatcgtaatgaacatcctgcgtcgcaagatacctgccgagaagattaacgaaaatctcgttcagcgcggcatcatgattttcgccattttgctggcctggagcgccatcgtactgaacgccccggtgttgagcttcacctctatctgtagcccgattttcggcatggtagggtgcctgatcccggcgtggctggtttacaaagtaccggcattgcacaaatacaaagggatgtctctgtacctgattatcgtcactggtttgttgctttgtgtttctccgttcctggcattttcttgatttacctgaaattttaaggtttttaatatgtttgattcgactttaaatccgttatggcagcgttacatcctcgccgttcaggaggaggtaaaaccggcgctggggtgtactgaaccgatttcactggcgctggcagcggcggttgctgcggctgaactggaaggtccggttgaacgtgtagaagcctgggtttcgccaaatctgatgaagaacggtctgggcgtcaccgttcccggcacgggaatggtggggctgccgattgcggcggcgctgggagcgttaggtggaaatgctaacgccgggctggaagtgctgaaagatgcaactgcgcaggcaattgccgatgccaaagcactgctggcggcggggaaagtctcagttaagatccaggaaccttgcgatgaaatcctcttctcacgcgccaaagtctggaacggtgagaagtgggcgtgtgtcaccattgtcggcgggcataccaacattgtgcatattgagacgcacaatggtgtggtgtttacccagcaggcgtgtgtgacagagggcgagcaagagtcgccgctgacggtgctttccaggacgacgctggctgagatcctgaagttcgtcaatgaagtcccgtttgcggcgatccgctttattctcgattctgcgaagttaaattgtgcgttatcgcaggaaggtttgagcggtaactgggggctgcatattggtgcgacgctggaaaaacagtgcgcgcgcggtttgctggcgaaagatctctcttcatccattgtgattcgtaccagcgcggcatccgatgcgcgtatgggcggcgctacgcttccggcaatgagtaactccggctcgggtaaccaagggatcaccgcaacaatgcctgtggtggtggtagcagaacacttcggagcggatgatgaacggctggcgcgtgcgctgatgctttcgcatttgagcgcgatttacatccataaccagttaccgcgtttgtctgcgctttgtgccgcaacgaccgcagcaatgggggccgccgccgggatggcatggctggtggatgggcgttatgaaaccatttcgatggcgatcagcagtatgatcggcgatgtcagcggcatgatttgcgatggtgcgtcgaacagctgcgcgatgaaggtttcgaccagtgcttcggctgcgtggaaagcggtgttaatggcgctggatgataccgccgtgaccggcaatgaagggattgtggcgcatgatgttgagcagtcgattgccaacctgtgtgcgttagcaagccattcgatgcagcaaacggatcggcagattatcgagattatggcgagcaaggccagataaacgccaggttttgggtatcgtgccggatgcgatgctggcgcgtcttatctggcctacgaattgcacaatttgttgatgttgttgggttttgtaggccggataaggcgtttacgccgcatccggcacctgtctttacgcggtagcttcatcctcggctaaacgcgtttcagcatccgcgacgatggcttccagctcgctcaacatctcttcatagccaaaattattggcggtgcgagcaggttctttcgccaccacgggcttcactggctgacgctttttggccgattttttactcatcatcatctccctgtaaaaacaactagacaggcaaatctatcagcaaagcgcgcagtggggaatcggcaaccagcgtaatgttagcctcgtcacgaataaacgccccatcaccgcaggttagcgccgctttctcttcatgatgcgtaagcgcatgaaatttcccgtgaatcgattgcaaatacgcgcgtggcccatgcaactggaaattcgcactttcgcctttgtcgagcacgatatggtgcagccacacttgttggcgtaattgcaggcttcccatcgcaccctctggcgaggcgattaattgctgcttgtccatattaagcgccagcttttgaatcagcggattctctcgctgcgggcaggcatccagccaaagctgcattcgcgttaacggtttgtctttgctgagattgtgttcgctatagctgacacccggctgggtagagagcagcaacgcctcaccggagctggcctgaacatgattgccttcgctgtcgcgatactctgcttctccatccagaatcacatttaaaatatcgactttgggataggttcgcggctgaaaggcggcacctggggccagcacttcctggttaagcacgcgcagggaggcatagcctaacaatttcgggtcgaagtagtgtccaaaggaaaaagtataccgggcctgcaaccatccgtagtctgcttgtccacactgcctggcagttcgggtagtaatcataattcttgacctctctttacttccttttatggtaaggggctggacgctacattgttagccagatattctgcccggtatgttcaaatttcctgaatgagaacgaaatggccaaagaaagggcattaacgctggaagcactacgggttatggatgcgatcgatcgccggggcagttttgcggcggcggcggatgagctgggacgcgtgccttccgcacttagctacaccatgcaaaaactggaagaagagctggatgtggtgctgtttgaccgctcgggccatcgcaccaaattcaccaatgtcgggaggatgttgctggagcgagggcgcgttttgctggaagccgcagataaactgactaccgatgcggaagctctcgcgcgcggttgggaaacgcatctcaccattgtgaccgaggcgctggtaccgacacctgcctttttcccgttaatcgacaaactggcggcaaaagccaatacccaactggcaattatcaccgaagtgctggcgggggcgtgggaacggctggagcaggggcgggcggatattgttatcgcgccggatatgcattttcgttcctcgtcggagatcaactcgcgcaagctctatacgttaatgaacgtctacgttgccgcgcctgatcacccgattcatcaggagccggaaccgttatctgaagtgacgcgcgtgaaatatcgtggaattgcggtggcggataccgctcgtgagcgcccggtgttgaccgtacagctgctggacaaacagccgcgcttaacggtgagcacgattgaagataaacgtcaggcattactggcggggcttggcgtggcgacgatgccgtatccgatggtcgaaaaagatattgcggaagggcggttgcgtgtcgtcagcccggaatcgaccagcgagatcgatattattatggcctggcgtcgtgacagtatgggggaagcgaaatcctggtgtctgcgggaaattcccaaactttttagcggaaaataatatttgttattgttaataacaaggggcgaaatatcgccccaattttaatattaatttgaaccaaatttcggatcgtttccgtaacgattgctgccagaattgccctctaaacaggcaaatacaaacagaactaaccagccaatgatcggtaccagatagagaagcgcccacgcacctgaacggtcagtatcatgcagacgacgaacgcacagagcaatgaccggaatgattgttgctgccaggtaaatgagagaaaggaacggaaactctaaacctaaaatcaattgaatgacattgataatagcgccgacgatggcgttaatcagagtaaacatccagtactctttacgacgtgcgcgaccagagaaaccaacataattttttaatacggataaataccactgcataaaaacatccctttaattaaaagtgacgaaagtctattccgggtattgtgtaaatgctattcgtatctttctttttcggatgttataaaggttttaatatttaagataaatatatggttgttttttatatgtaatttatataacgacattgaaatattttaactaaacattagtaaattattcattcatcaacatgatgataaaagccggatgagtcagacatccggcgagcagatttgttttaaggttccagttttggatcaggtccaaagcggttttcgcctggcgtacccgcctggcagttaaagacgatgataataagccagccgataaacgggattaagaacagcagtgcccaccacgccgagcggtcggtgtcgtgcaggcggcggaactgaaccgcccaccacggtaaaaacaccagaataccgtagattgttgtcaggatgccttcgccaccagcgcgttgccagcctaacattttatccagcagccccagcacgaacgtaaagatgatgttgaccagaataaacatccagtactctttgcgccgcgcacgaccccggaaaccgacataattttttagtactttcagataccagtccatttttgcctcaattttgctcaatcacttgtttttaaagcagcaaattaagaatagacgtgaatgaaatggcagtaaatattcgttcaaggaattaataaagtgccgtgaaggcgcgctaagactgatgacaagcgcaaaatcgccagatgcgctacgcttatctggcctacgcggcattgtaacatattgaatataaacgttttgtaagttggagaaaacgttcacgccgcatccgacataaataacacgcacttagctaataatcagaggcacctcgtaaggtgcctttttttaaccgaagcgaacatctcgtccatgcggttcatcgagatcctgccacggaccaattgaaataatccccgtagggttgatggtcttatggctgcggaagtagtgattacggatgtgatcgaaattgacagtttcggcaatccccggcatctggtagatatcgcgcaggaaaccatacagattcaggtaatcgctgatgcggtgcttatcacacttgaagtgggtgacatacaccggatcaaaacgcaccagcgtggtccacaggcgaatatcggcttcggttagctggttgccggtcaggtaacgatgctggcctaaaatctgctccagtcgcgccagcgattcaaacactttcactaccgcctcgtcgtaggcttgctggctggtggcaaaaccggctttatacacgccattgttaacggtgtcataaatccagccgttaagttcgtcaattttcgtttgcagggctgatgggtagtaatcaccagctttcgcgcccagcgcatcaaacgcggtattgaacatgcggatgatttctgctgattcgttgctgacgatggtgtggttctttttgtcccacagcacgggaacagtaactcgtccgctgtagtgtggatcggcgtggagataaagctgatacaaaaattcatgttgatagagtgtatcgccggttgcacccggaaaactgtcatcaaaggtccagccgttttccagcatcagcgggttcactacggaaacggaaataaacggttccagtcctttgagtttacgcatgatcagcgtgcggtgcgcccacgggcaggcgagtgaaacatagagatgataacgatctttctctgcgataaaaccgcctgtgccagtggggcctggcgcgccatcggcagtgagccagttacgaaatgcggaagctgaacgttgaaatttaccgccggtagatttggtatcgtaccaggtgtcatgccagacgccgtcaatcagttgacccatatttctctcctccaatagcaaaaacgaggagcttcctcctcgttttttatcgttaagtatagcgcgtgcttaccactttttattcagcaggcggtcgatgctatacgcgcccggaccggtaattgccagcagcaggaatccgccagaaattgtcaggtttttcatgaacatcagcgagttgacgccttcagcaaagttgctgtgaaataaaaatgccgtcagcagcgtaaagcccgcagtaaacagggctgtggtgcgagtcaggaaaccgaacaggattgccagaccaccaccaaactcaagcagaatcaccagcggcagcataaagcctgggacacccatcgcttccatatattgttgggtacccgcgtagccagtaatttttccccagcctgcggtaataaacagaatcggcattaaaatgcgcgctaccagtacaccaacatcttctaattttttcatcatactctccactgcgccactcaggctgctgattgtttttttgtgcaagggcgcggtattagcgtcgttgctgtcgatggagagaatcataaacgtggtgaatgatgattgttagcaaggaaaactgtcaaaaatcttcaaaaaatttgagggataaggccggaatggctccggccagagaggttattaaccgcgaagctgttgctgcttgagggtcgttttaaccagacgccaggcgctccataagccaaaaccgcgtctggcccagcggaccagcatattaggatggcgaatcgtccagatcgccatcacgctactgccaaccagcgcccaggagcgcagacttagcagcatattccagcgacgatcgtaagcgcctgttgcctccagccattcacgacgactggcagaaagatccagccgttgttgctggatctggctaagcagttgcgccttacgtcgttcacgttcgactttactgctcacgggactcctcctcgagcagctgccgatcgtttgccagctcatggcgtgtatggcgcagcaaggtggatttacgcgatttacgtaacgtccagataccgccaatcagtgccagtagcagcaacaccacggtggtggcaatcatcgcattcaggcgatattgcggatcaaccgcccaaataatcagcaccatcaggctcataagaccaaatgcagcgaaaagcatcgtcaggcccagcatcagtaaaagttgaaagagattcgctttttcctcttccagctccaccaccgccagccgcagacgtgtttccaccatttcaaccatgatggaaacaattcgctgcccgatgcccagaacgcttttaccgggcccttgcgcgtgatgagtgtccgccataattaacgacgcgatagcagaacgccgagcactacaccgattgcagcgccaatgcccacgcccgtccatggattttcacgcacatactcatcggcacgcgccgccgcgacacgggtttgtttggcgatggcatcaccggtttcacccaggcgataacggctctgtttcagtgcctgctccgctttgctacgaatcttactcaactcttctttcgacttctcgccagatgagctaagcacctcttccagcgtatcggaaagggatttcaactcagcacgcagatgttccgtagtgtgttctttcgacatagttttctccaggtgagtaagtagtgactattgtgagttagtagtcgcgcgcttccagctttttcagctcttcctgcgcttctgccagtttccgttcgcgtttggcaatcttatcggcatcgcctttttgcttcgcctcggttaaatcttgctggcgttccgccacctcatctttctgctttgcgattttcttctgatgatcggcacgcagctggctatctgaacagttggcccggacttcactcagggctttattcagaccgtcaatacgattctggttttggtgtttttcggcatagctgatctccttaaggatattttgctccttttcctgacacagggtagtggcataactaccggcactaagagcaaagagagaaacagctaaagcgatgcggtatttcattcttgaaccttccattgtgattcggacctattacaaaggaacgattgtccagacaacgaagcggtagtgttaaccaccgcctcattaatcatagacagttacggtgaaatcaccaaagtcagtgatatgtttcggataacaggaagttatccgaagcgatgagagttatcccgcaaccgggtcagccactgcatagcctgactattattgtcctgctgcgcgatgatgtagccatggggcaatgttctgtcgaggaccgcttttgcggcggcactctggtcgctggagtcaaaggtaattaacagagtgtcatttttgggggtgatacttttgaaaggaatgccgtgagcgtcaaggtgatgccagattgaaaaaccgtctggcatcgttgtcccttgatgaacggcacgaatcgccagcgtagactcttgctggcgaaccgcggaccaggccagcaacagtgtgccgaccagaagtaaaacagcgccggaccaggctagctggcgaagcgacatgcgaggtatttgcatcccttacccccgatttccatatttctttttccataacacgaccagagaacctgccaggccaaacaccagcagcaccaccgggagcagcatcaggcatgacatcagctggtcctcgtactttaaaaataccggcgttttgccgagcatgtaacccagagttgtcaggatcaatacccacagcagaccgctcatccagttgaagaactgaaagcgcgcgttattcagccctgataatccggcaatcgtcggcagcagtgttctgacaaatgcaataaagcgaccaattaacagcgccgataaaccgtgtttatgaaaaagatggtgtgcgcgttgatgataatgcgcgggtaaatgagatagccagttttgtacagtgcgggtattgcccaaccatcgcccctgaatatagctgacccagcaaccgaggctggcggcaacggtcagcagcagaatcgtttgcggatagcccatcgcgcctttcgcaatcaatacgccgaccaacaccagtaaactgtcgcccggtaaaaaggccgccggaagcaagccgttttcaaggaacaaaattacaaacaagacaaaatacaacatgccaatcatcgacggattggccagggtttcaaaatcctgcgcccacagggcttgcagcaattgggtcaaaagttccattcattattcctggtgaatcggttaacgccacgctggttttaaaagatgcactaccgcaatgttattgctgttttggtatgttttgcgggtttgatacatcaacacagcctgaactattccctgttaaatcgtgagataagaaagcattcaaaagcataaattcaaattgaatctaattgtaacaaaggtcaacgttgttcgttatcaaaattacatgtccgtggagtctgattttgctgattgcaggggagggtggcgagaggatttacacaggctgacactttatacttttcgcttaccgacgaagcaaacaggcgcattgcagcgcctgtcggatggaaatttcatttgctgccgctggtggccgtatcgagatgcactaccgggttttctgcgaacagatagcggtcggcattgaactcgaaatcgtcgctggtttcgttaaataacatgattttggtgttttccagatgctgccacattgccagcttggcagcatgaggatctttgcgaattaacgccttgaggatctgatcgtggtcatcgcaccagttatcgacagtacgggcatcaatgtgttcgtgtagttttttccagtacgggttatggctacgttgggtccacattttttcaacgatagccgccagggcggagttctgcgtcgccagggctacctgaatgtggaactgcaaatcccactcggaatcacggaagcattgttcgccgcgcgcctgctcctggatggccatcagtttcatgatgtcctgtttcgttacctgagttgccgcgaactcggcaatattactttcgatgagctggcgagcctggagcaactcaaacggaccgtaattggcgaattccatattattgtccgccgcctgctgatgacgcggctggttggaaaccacgtgaatacctgaacctttacgcacctccacatagccttcaacttccagcatgatgatggcttcacgaactaccgtacggctgacgttcttttcatcggcaataaagcgctcagcaggcagtttatcacccaccagatagacgccctgttcgatgcgctctttcagatcagcggcaagttgttgatacaaacggcgtggttcagtgatttccatatgcgctccaggcatgatacggcagactatatttgttataccacttttgcgagtttagctctactcacagtgatgaaaaagccgcctgagaaggcggctttgaagggaaactaaaacttacacgaagccttaatgttgcggtgcaggatcgttatgtgtttcctgcgccacctcaatcgccggtttgttctgcaacaccgtccagataaccagcgcacccagcaggtcaaatactgccagaactgcgaacagcgggctgaagccgatggtgtcagccagtgcaccgacaaccagcgcaaacagcgtacttgccagccatgcggacatcccggttaaaccgtttgccgttgccacttcgttacgaccgaacacgtcagaagagagcgtaatcagcgcgccagacagtgcctggtgagcaaaaccaccgatacacagcagcataattgcgacatacgggttggtgaacagaccgatcatacccgggccaatcatcagcacagcacccagcgttacgaccatcttacgagaaacgatcaggttaacaccaaaccaacgctggaacagcggcggcaggtaaccaccgaggatacaaccgaggtcagcaaacagcatcggcatccaggcaaacatcgcgatctctttcaggttaaagccgtaaactttaaacatgaacagcgggatccacgcgttaaaagtaccccaggccggttctgccaggaaacgcggcagtgcaataccccagaactgacggttacgcaggatctgaccaacggacattttcttcgccgtgctcacctggtgctgggcttcctgaccattaataatgtagtcgcgttcttcatcggtcagatgcttctggtcgcgcggatgtttatagaaaatcagccatgccattgcccagataaagctcaatgcaccggagatgataaatgccatctgccagctgtgcatcacgattgcccatacaaccagcggcggcgcaatcatcgcaccaatagaagaacctacgttaaagtagcctactgcgatggaacgctctttcgccgggaaccattcggagctggctttcagacccgccgggatcatcgctgcttccgcggcaccgaccgcaccacgagcaatcgccaggccaccccagctacctgccagcgcggttgcaccacagaatacggcccacagtacagcaaacattgcgtaaccgattttcgtacccagcacatccagtacataacccgctaccggttgcatgaccgtataagcagcagaataggctgcgatgatataggaatactgttgggtggagatgtttaactcttccatcagagttggcgcagctgccgccacagtgttacgcgtcaggtaaccaagcacggtgccgagcgtcaccagtgcgatcatataccaacgtaaccctttaattttacgcatgtaaaacctcatcgttttgttatatccgcaggaagcgcggccatcatcccgccagaggctgaagatgttagttacgaccgggtaaccgaaaaaaaaccggcacgccccgaacgttgccatgaaagtttcgtgctaattcggcttccgtaccggttaacccgattcatctaacaaatgaatgaatcggcaatttgcattccgtcgacttatgatttgcgacggcagaaagataacttgtcatacaactttaaaaggtgagagccatcacaaatgtgggaatatttgtagggacattacctgacgacagcgaggccagtactggcgcggcctgcagcgagatttaccactttgagagtaatttttttaactacgtttattgatctatctcacgaaaatatcttcggactctggaaattggtgtgataactttgtcagcatcgcaccataagcaagctagctcactcgttgagaggaagacgaaaatgactccgtttatgactgaagatttcctgttagataccgaatttgcccgccgtctgtatcacgactacgcaaaagaccagccgattttcgattaccattgccatttgccgccgcagcagattgcggaagactatcgttttaaaaatctgtatgacatctggttgaagggcgatcactacaaatggcgcgctatgcgtaccaacggtgtggctgagcgtctgtgtactggtgatgcgtctgaccgtgaaaaatttgacgcctgggcggcgactgttccgcacactatcggcaacccgttataccactggacgcacctcgaactgcgtcgtccgttcggtatcactggcaaattgctttctccgtcaactgccgatgaaatctggaacgaatgtaacgaactgctggcgcaggataacttctccgcgcgcggcatcatgcagcagatgaacgtgaaaatggtcggcaccactgatgacccgatcgattctctggagcatcacgcagagatcgccaaagacggctctttcaccatcaaagtgctgccgagctggcgtccggacaaagcctttaacatcgaacaggcgacctttaacgactacatggcgaagctgggtgaagtctctgataccgacatccgccgctttgctgatctgcaaactgccctgaccaaacgtctggatcacttcgccgctcacggctgtaaagtgtctgaccacgcgctggatgtggtgatgtttgctgaagcgaacgaagcggaactggaccgcattctggcgcgccgtctggcaggcgaaaccctgagcgagcacgaagtggcacagttcaaaactgcggtgctggtgttccttggtgccgaatacgcacgtcgcggctgggtacagcagtaccacattggcgcactgcgtaataacaacctgcgtcagttcaaactgctggggccggatgtaggttttgattccatcaacgaccgtccgatggcagaagagctgtctaagttgctgagcaagcagaacgaagaaaacctgctgccgaaaaccattctctactgcctgaacccgcgcgataacgaagtgctgggcaccatgatcggtaacttccagggcgaaggtatgccgggcaaaatgcagttcggttccggctggtggtttaacgatcagaaagacggtatggaacgtcagatgacccaactggcgcagctcggtctgctgagccgctttgtcggtatgctgactgacagccgtagcttcctgtcatacacccgtcacgaatacttccgccgcattctgtgccagatgattggtcgctgggtggaagcgggcgaagcgccggcggatatcaacctgctgggcgagatggtgaaaaatatttgctttaacaatgcgcgtgactacttcgccattgaactgaactaaggtctggggttgatatgcaatacatcaagatccatgcgctggataacgtcgcggtcgctttagcagatttggcggaaggcacagaagtcagtgtcgacaaccagactgttacgctgcgccaggatgttgctcgtggacataaatttgcgttaacggatatcgcaaaaggggccaacgtcatcaaatatggcctgccgattggttatgcattggcggatattgcggcgggggaacacgttcacgcccacaatacgcgcacgaatctgagcgatctggatcagtatcgctatcaacctgattttcaggatctgcctgcgcaagcggcagatcgtgaagtgcagatctatcgtcgcgctaacggcgatgtcggggtgcgcaatgagctgtggatcctgccaaccgtgggctgtgttaacggcatcgcgcggcagatccagaaccgttttctgaaagagaccaacaacgctgaaggtaccgacggcgtgttcctcttcagccacacctacggctgctcacagctgggcgacgatcacattaatacccgcaccatgctgcaaaacatggtgcgccacccgaacgcaggcgcagtgctggtgattggtctgggctgtgaaaacaaccaggttaccgcattccgtgaaacgctgggcgatatcgatcctgaacgcgttcatttcatgatctgccaacagcaggatgatgagatcgaagccgggatcgagcatctgcatcagctgtataacgtgatgcgcaacgacaagcgcgagccaggcaaactcagcgaactgaagtttggtctggagtgcggtggttctgacggtctttctggtattactgctaacccgatgctggggcgtttctctgactacgtgattgctaacggcggtactaccgtactgaccgaagtgccggagatgtttggcgcagagcagttgctgatggaccattgccgcgacgaagcaacgtttgaaaaactggtcaccatggtcaatgacttcaagcagtactttattgcccatgaccagccgatctatgaaaacccatcgccggggaacaaagcgggcggtatcaccacgctggaagacaaatcacttggctgtacccagaaagcgggttccagcgtcgtggttgacgtgctgcgttacggtgagcgtctgaaaacaccggggctgaacttgttaagtgcgccgggtaacgatgccgtagcgaccagcgccctggcgggtgcgggctgccatatggtgctgttcagtactggtcgtggcacgccgtatggtggatttgtgccgacggtgaaaatcgccaccaacagtgaactggcggcgaagaaaaaacactggatcgactttgacgcgggtcagctgatccacggtaaagcgatgccgcagttgctggaagaatttatcgataccatcgttgagtttgccaatggtaaacaaacctgcaacgagcgtaacgacttccgcgaactggcgatcttcaaaagcggcgtaacgctataaagtcgaaatgagttgttaataaaaaacggcgtttcataatgtgaagcgccgtttgcttttccatacctgctaaggatttatcatgaccgcgtattggctggcccagggcgtgggtgtcatcgcctttctgatcggtatcacaacatttttcaatcgtgacgaacgtcgcttcaaaaagcagctttcggtctatagcgccgttattggcgtacatttttttcttctgggcacctatcccgctggtgccagtgccatccttaatgccattcgtacgctgattactttacgcacgcgcagcttatgggtaatggcgatttttattgtgctgactggcggaattggcctcgcgaagttccatcatcctgtcgaactactgccggtaatcggcacgattgtcagtacctgggcgctgttccgctgtaaagggctgaccatgcgctgcgtaatgtggttttcaacgtgttgctgggtgattcacaacttctgggcggggtcgataggcggcacgatgattgaggggagttttctgctgatgaatggtctgaatatcattcgtttctggcggatgcagaaaaggggaattgatccgtttaaagtagagaaaaccccttccgccgtagacgaaaggggttaaacaattaattacgcagggcgctatttgccagacgatcgtcttctgcctggcaagctgccgcagtgaacagcacgtcagttgaagagttcagcgcggtttcgcaagagtcctgcaatacgccgatgataaagccgacggcaaccacctgcatggcgatatcgttcgaaataccgaacatattacaggccagtgggatcagcagcagagaaccccccgccacgccggatgcgccacaggcacacagagaagccactacgctcaacagcagcgctgtgggcagatcgaccggaatacccagcgtattaaccgcagccagcgtcaacacggtaatggtgattgctgcgcccgccatattgatggtggcacccagcggaatagaaacggaataggtatcgcgatccagattcagcttttcacacagcgccatattcaccggaatgttcgccgcagagctgcgggtgaagaaggcgtacacgccgctttcgcgcaggcacagcagcaccagcgggaacgggttacgacgaattttccaccacaccagcaaggggttaaccaccagcgccaccagcagcatacagccaaccagcacgaccagcagttgcgcgtagccccacagtgtggagaaaccggtggttgccagggtagaagaaaccagaccaaaaataccgatcggtgcgaagcgaatgaccagtttcaccataaaggtgacggcattcgacatatcgttgaccaggtttttggtggtctcgttaccgtgacgcagtgcgaaaccgaggccaattgcccacaccagaatcccgatgtagttacctttcagcagcgcgtcgatggggttggaaaccatgctcattaccagcccgcgcatcacttcgacaatgcctgacggcggcgaaatatcacccgcgctactggacaagtgcagggtagaagggaaggcaaagctgaagactactgcggccagagcagcagagaaggtgcccagtagatagaggaacaaaataggacggatattggttttctgcccgtgctggtggttagcaatagacgccattaccagcatcaacaccaggatgggggcaacggctttcagtgcgccgacgaacaaagtacctaacagaccaacagcttccgccgcgggttttgagatccatgccagaagaatccccagaacaaggccgaccaggatttgttttaccaggctgccatgagccagacgccggaatagccccggtgaacgttgcgtagtcatttttcgatcctttcattgtgttgtcgcacatccctggtgcgttctgtcgacgcatctttcaggatgtaacaaagtgtttgcaaggtcgagtataaggaaagttacagcttcgggaagcgaaaaatgctggattttaaagagaggtcatattttgcaacttcatggttacatttatttgacataaacagagggaaggactggctactaaggctgattagataacatatgggcaaaactatttggaatatgagaacggttgcgctcctttaatgtgctatgccatataaagtcaatgccgcagggagcgcgcagggggcggccaatcgccgccgccccctgcacccccaggctctggcgaacaaaatcgccgctgcgcggttccctcagcttatcccttgcggctaccgggtcgggcgcaagggaacgtccctgtaagatgcgccctcgccgcgcatccatgcgcgtcgccccggcctccagggaacgcttcggcgattttgacgccaccaacacccgtgcggtctttttgtaaagagctataagccgattacataattaatagctcacctttgtctggaatgagttatctctagtaatggcttaatatacagcgaatcattctccccgctgcttatcatgccgataattcacccaggcgttgataataaacgtcatcaccagaatgccaaacaccacgcccagcgagacggcgattggaatatggtagaagtcgacaatcagcatcttgataccgataaacaccagaatcaccgccaggccatatttgagcatcgagaaacgttctgctacgcccgccagcaggaaatacatcgcacgcaggccgaggatcgcaaacaggtttgaggtcagcacaatgaacgggtcagtggtcacggcgaagatagccggaatgctatccacggcgaaaatcacgtcgctcaattccaccagaatcagcaccagcatcagcggcgtggcatacagcaagccattcttacgcacaaagaaatgctcgttgtcgatggtgtcggtcatgcgcaaatgaccgcgtagccagcgcaccagcggcttgtcgccaatgcctgattcatcttcatgggccagcgccatcttcacgccggtaaacagcaggaaggcaccgaagatatacaggatccagtcgaactgcgaaatcagccagctgccagtgaagatcatgatggtacgcagaacaatcgccccgagcacgccatacaccagcacgcgccgttgtaacgccgccggaacagagaaatagctgaacaacatcagccagacaaagacgttatcgaccgccagcgatttctcaatcagataacccgtgagaaaggccagtgcctgtggatcggcaacggcgcgaccttcggtttgcaccagataccaccagaaagcggcgttaaacagtaacgacagcgtcacccagaccagcgaccaggccgcagcctgtttcatggtcatgccatgtgccccacgacgcccctgcaacaacaggtcgatagccagcataatggcgacaacaacagcgaatccgccccatagcaacggcgtgccgacagtattcatagaagttccttacacataaaaaaacggccaacgtcggaagacgtcagccgctgctttttatgcatagacctcgccttccggcaaggtctcacttacaacaaaaaaggaatacgtctgcgtattcctttcgggttgcccggtgaccggatgtggtttttcacacatcgtaatgacgatcgaccggcaatgaagttactcccctttgcaggtaacaaagtatgacagaccattcagtcagtcaatggtctgttacatgccttttacactgctttactttggcaattatagttttacgctatctgccggaaaaatcaccccagtctggcggcggatctcggtcagcagtttggcggtgatgcgactgaccgccagccctggatgatccaccagatgttcatccaccagttcagcaaacagctctgcttcgtagagcatggtattaatatgctgcggttgggtgagatcctgcatctggctgccacgcggaacaaagcaaactttctggcattcagacagtttttcaatcaccagcgatcctgcttcgccctgaatctcgcttgccaggacagaatcgctcacttttgagtgctgcaacgtaacgctgaaatcaccgtaatccatcaccaccacgccgtgggcatccacaccgcttgccagcaaactggcggttgcctgcacgcttttcggttcaccgaataatgccaccgccgacgccaggcagtaaaagccgatatccataattgaaccgttagagaatgccggattaaaggtgttgggattctcaccatccaggtaacgttgataccgcgaggaatactggcaatagttgaaaaagactttacgcagtttgccgactttcggcagtgcctggcgtaacagatgaaagttcggcaggctggcggttttaaatgcctcaaacagcaccacctgattttcccgcgcacaggcaatggcggcatccacttccgccagattcgatgccagcggcttctcgcaaatcacatgaattttgtggctaaggaaaagttgtgtctgggaaaagtgcagggcattcgggctggcaatatacaccgcgtcaatggcatcgctttctgccatcgcttccagcgacgtaaacagatgctcgacagaaaaatcattggcaaagtgctgggcctgttcaaggctgcgggaatatacggcggttaacttgtatttaccgctctcatgggcggcctcgacgaactggcgagtgatccagttcgtaccaatcacagcgaaacgtatcataacgcgtggatactccataaagggattctgccgtcaatgtagcacgcctttttcatcttcgacgtgcgcagatacgcattatttctgcgccggacagccatgctcactaaacggcccaatcatgaccgatggcccgagatatttcggctggcgatggaggattttggcgtcaatcaccgcgctgactctggcgagtttctcccgtaactgagtataaaaaccgtgcttcatattgaggtctggcgcgttaaagccgatagcgtcgatgccgtactgttttgccagccagatggcgcgttggttatgaaattcttgcgaaataatggtgatatggttttcaccaaacacctttttggcacgcaccacggaatcaagcgttgagaatccggcatagtcgcagaagatcactttcgccggtacgcctttagcgatcaaagcctgctgcatacctgaggcttcatcgtaatttttacgtccgttatcgccacttaccagtagccatttcacttttccggcgtggtacaacgctgctgcggtatcaatacgtcgggtaaagtagcgattacccggcctcgcccccagcaataaacccacgttacgcgccggaactgcgttgacatcgctccaggtcagctgcttgctggtgttgaccataacgcgatcggcaataaaaatggtcgctcctgctataagcaacaataaacagccaatcttaagagtccggcgagaaaaacaaatacggagaagaaggcggggctgcatggtcgttatccttaacgaaaggggggaggtcgattttaggcgctataggaagaaaagataacgcctgacatcattttcagattttgtcctgcccaagcgacaactgcgttagccacagccgggtgtcgaactcaagctggtggtactgcggctccatatggcagcacaattgatagaacgctttgttatgctctttctccttcaggtgcgccaactcgtgcaccacgatcatgcgcaaaaacggttccggcgcgttgcgaaacacggtagcgacgcggatctccgcctttgctttcagcttgccgccctgcacacgcgaaacagcggtatgtaacccgagcgcgtttttcagcacatggatcttgttgtcatacatcactttagtgatcggcggggcattgcgcagaaactgatttttaagatcctgagtatattgccagagggctttatcggtggagtagtcgtgtgttcccggatagcgttttgccagcacatcgcccagacgctgttcgttaatcagcgttcgcacctgggaaagtaggtgctcgggataaccctgaagataagtaagattgctcataaccgcccacgaaaaagagaaaaagggtatactcacgcacccttttcaggggcaacgtcgaaattttatcattcaggagggccgatgagccacttagacaacggtttccgttcactgacactacaacgttttccggcgacggatgacgttaacccactacaggcgtgggaagcggcggatgaatatttgctgcaacagttggacgacacagaaatccgcggcccggtgttgatcctgaatgatgcctttggtgcgttaagttgtgcgctggcggaacataagccatacagcattggcgactcatacatcagcgaactggcgacgcgcgagaatttacgcctcaacgggattgatgagtcgagcgtgaagtttctcgacagcaccgctgactacccgcaacagccgggagtggtgctgatcaaagtaccgaaaacactggcattgttggaacagcaactgcgcgcgctgcgcaaagtggtcacgccagatacgcgcattattgccggtaccaaagcccgtgacattcacacttccaccctggaactgttcgaaaaagtgctcggcccgaccaccaccacgctggcatggaagaaggcacgcttaattaactgtactttcaacgagccgccgctggccgatgcgccgcagaccgttagctggaaactggaaggtactgactggactatccacaaccatgcgaatgtcttctcccgcaccgggctggatattggcgcgcgcttctttatgcagcatctgccagagaatctcgaaggtgagattgtcgatctcggttgtggtaatggcgttattggtctgacgctgcttgataaaaacccgcaggcgaaagtggtgtttgtcgatgaatcgccgatggcggttgcttccagccgtttgaacgttgaaaccaacatgccagaggcgttggatcgctgcgagtttatgatcaacaacgcgctctccggcgtggagcctttccgctttaatgctgtgctctgcaacccgccgtttcatcagcaacatgcgctgaccgataacgtcgcctgggagatgttccaccacgcccgccgctgtctgaaaatcaacggcgagctgtatatcgttgccaaccgtcacctggattacttccataaactgaagaagattttcggcaactgcaccaccatcgccacgaataataaatttgtggtgctgaaagcagtgaagctggggcgtcgtcggtaagattggcagctacctgccagataaggcgtaaacgccttatctggcatacgttcagcacattacccccaggtcggataagacgcggcaagcgtcgcatccggcaatgtctgcccagttctggaatcgcgtttccataaaacaaaaaatccctgtcaccatcctctacattctcttgtttagcatttttctacgtttattcttccgtcacacagataaattcattcgttgccaatctgtcaacggatgttatcatattgccaatttgtcaacggacgtgatgaagaatgcacctgataactcaaaaagcattgaaagatgctgcggaaaaatacccgcaacataaaacggagttggtggctctggggaacacgattgctaagggatatttcaaaaaacctgaatcattaaaagcagtattcccatctctggataacttcaaatatctggataagcattatgttttcaatgtcgggggcaatgaattacgtgttgtagcaatggtcttttttgaatcgcaaaagtgctacatacgtgaagttatgacgcataaagaatacgatttctttaccgccgttcatcgtactaaggggaaaaaatgattgcgattgccgacatcttgcaagcaggagaaaagctaactgctgtggcaccttttctggcgggtattcagaacgaggaacaatacgcccaggcgctggaactggtcgatcatctgctgctcaacgatcctgaaaatcccttgctggatctggtgtgtgccaaaataaccgcgtgggaagaatcagcgcccgaatttgctgaatttaatgccatggctcaagccatgcctggcggtatagccgtgattcgtacccttatggatcaatatggtttaaccctttccgatcttccggaaattggcagtaaatccatggtgtcacgcgttttgagcgggaagaggaaattaacgctggaacacgctaaaaaactggcaacgcgattcggcatttctcccgccttgtttattgattaacgcgacgtgccggatgcgtcgcatccggcgcttcaaataacgatttaaatctccagcgccagccgtgttccctgggcaattgcccgtcgtgcgtccagctccatagctacatcgcagccgccaattaaatgcacagttttcccgccatcaatcagcggttgcgccagcgcgcggtttggctcttgccctgcgcagatcaccacattgtccactgctaatacctgcggttcgccgttgatcaccacatgcagcccgtcatcgtcaatcttctgataacttacgcctgggatcattttcacaccccgcgagagcagggtggtgcgatggatccagccggtggttttgcctaacccctgtcccggtttgctggctttgcgctggagcatcacaatctgccgtgggctacgcgggatctgcattccctgcgggcttaagccaccagcctgttgcaggctgctgtcgatcccccactcattacagaactcggcaatgttctggctggtggactcacccggctgacttaaaaacatcgccgtatcaaaaccaatcccgccacaaccgatgattgctacctttttgcccacaggcgctttgtcgcgcagtacgtcgagataactcaacaccttcggatgatcgattccgtcgataggtggaatgcgcggtacgatcccgctagcgaggatcgtttcatcgaacgactgtaactgatccgccgtcacggtgtgattgagtttcagcgtcacgcctgttacttcgatcatccggcggtaatagcgcagcgtttcgtaaaactcctctttgccagggatctgtttggcgatattaaactgaccgccgatctcactgtgagcatcaaacaacgttacctgatgaccacgtgccgccgcgttaatggcaaacgccagcccagccggaccagcgccgaccaccgccagattttttttctgcacggcgggaaggatcggcattttggtttcgtggcaggcgcgaggattcaccaggcacgaggtgactttgccaacgaagatctgatcgaggcaggcttgattgcagccaatacaggtgttgatctcatcggctcgccccgattgcgcttttgacagcagttccgcatcagcaagaaacggtcgcgccatcgataccatatcggcatcaccgcgcgagagaatgtcgtcggcaacctgcggatcgttaatccggttggtggtcaccagcggcagcgagacgtggcttttcagtttgcgcgtgacccagctaaaggcaccgcgcggcacgggcgtggcaatggtcggaatacgtgcttcatgccagccaatgccggtgttgataatggtcgcgcccgccgcttcaatggcctgcgccagccctaccgtttctgcaaaagtaccgccgccttctaccaggtcgagcatcgacagacggtagataataatgaagtcattgccgacgcgttcgcgcactgctcgcaccacttcaactgcaaagcgcatccggttgcggtaatcgccgccccactggtcgctacgctggttggtgcgcagggtcagaaactcgttgatcaaatacccttcggaacccatcacttctacgccgtcgtatccggcctcccgcgccagttgcgcgcagcgggcgaaattgtcgatcagttgcaggatctcttcatggcttaactcatggggaacgaaacggttgatgggagcctgcaatgcggaaggagcgaccagatgcggttggtagctgtagcgcccggtatgcaaaatttgcagggcgattttgccgccttcctgatgtacggcttcggttatggtgcgatggtgcgggatctggcttgcgtcattgagcattgcgccgccttccatgccaacgcctgttaaatctggtgcaataccgccgctgacaatcaacgccacgccgtgacgggcgcgttcagcataaaacgctgccagccgttcagcgccgtccgggtattcctccagtcccgtgtgcattgaacccatcagtactcggttttttaacgtggtgaagcctaaatccagcggggcgaacagcgacgggtagctcataaaattgtccagtatgtaaaataattgttatgtggtcggatgagttctaatttagccgtcgccggagaaaagggaaaaggggagtgtggggtttgtgatgggattcaaaaagaatacgcctgttcgtcatgccggacggcggtaatacagtcgtccggcatcgggaaaaattactgcttacggaaaaaatcgttatacaacatatacaaatgcgcggcgctccaggagaaatttggtgcgccttgctgcgcgccagtgagcgggttgtaattttcctgaatcgggccgtcggcggttaaccctttggcgtgccggaagaacgtatccgccagtttcagggcatcatcacgataaccgtaacgctccatccctttcagaccaaaccagaactgatccacccatacgcgcccgcgccagtagatatcagcgccaaaagccggattggttaacgccgccgttcccagcggaacaaaggtgttgaactctttaggatcgagcatcaccttcaccaccgcgtcggcgttggcctgcgttgccgcaccgttaaacagcggtgaccagccttctggccctttaccgcgctcgacaatcggtttgcccgcgcagccgttcggcagcggtttatcttcaatgcgcacgtcatagtagaactgggtagtcgggtcgaacatacaggtgttgatgtagtccgcgagctgctgtgccaactggcgatagcgtttggcctcttccggcttaccgagtatggttgccatctccgccagataatggttatcgctgtacatatagctggcctgatccaccgactcctgcaatagcgagtaccccagcaacgttccgtcctgactgcggttttcggcgaatttcaccgtccagtcgctacgtttgccgccattagcgacatatttatccagctgttctttgtcgataaacccaaagacggcggcgtcatcacgacctgattcccacgacgcagcaacctgtgccggaatttccagactgtcgtactggcctttctccaccacacgggcgtagttgttcagcccagactgcgtctcttctttgtcgccttttttcaccgtaaacagcatctcgccgctctcggtgttgtgggctttgtcgcgggtcgcaccatattccggcacgccgttgccgttgtgatcgcgattacgtaaccaccagtcgtgataggccaccagcttcgggtacatctctgccaaccaggctttatcctgggtgacgttatacacttccattactgaccaggcggcaaggctgggtttggtattacgttcgttccagttgccgccatcgccgccacgctcggggctaaggttccacgctatcaggtcggggacaaagcccacatcctgcggacgcacgctgtcgccaggctggatctgccaggagaagaccgcgcggatattctctttggcgatgtccggattgaaatgcgccatcgcaaacgcctgcttccaggtatcccacggccaggtctggttgccggagaaccagcgtccggtcaccgacggcgtgacggtgttatatttcaccgccccgcccggcgagcgccagttaccgttgagcgtttcgatcgctttcaccgcgacgcgcgtctgttccggcgtcgcatccggattggttaaccctttcttcagatactcttcccagcgttgctgcgaggcggtgagataaaacgccggacgcgccagaatatcgcggatctgcatttgctctttgctaacttcctgagcggtcagcaggtgggagtaggtggtatagagcgtggtcgaaccgttgatatgcgccttactggtaaagcgattgccgttgatttcagtctgcaccggcagggatttatgcacctgatattccgattcgccggaggtcagcagatcccaggtggcgcgcactttgccaaaggtgactttcaggccatcacgggtggcgctgattttgcgctggtagtcagggtattcgccagcaatggttttatcggaaagcggtttcccttctttcgcttccagtttttccagcagttcgccgtcccacaccagatccagcggtttattgctgatgattttagtttccagtagtgacgtgcgtggcgtggcgaagcgaagagtcatttcaacctgtacatcttttgctgtcagtttttgcaccagcgcgccgggaatactgtatgcctccagcgtgaagtcgactttcttaccgtcctgccagacggtcaggcggtcgaaattgctggccataaagttgatgtactcttccgtcagcagcgcaacgcccggaaaaccgcccatggtattcgggccgtctggcaacagatgaccatgccaggctccgagatcgaaaaacggattaaaacgctggtgatcgtcgtaatcgtaatccttcatgtactgcggtgcgccagtacggttaatcacgtttttataattgtcagcattagcggcatgggcggaaaagctcatcagcagagcacaggctactggcgttaaaatagtttttattttcatgagattactgtccttattaccagtaaaaatattgcatcaggaagatttggtcgctgggatcgttagaggcatttttcatgtagaagcggctatcaaaagccgttgcgaaacgtccgccgccgtattcgtaccagataccaaactgcatgaaagaggtggtttcatcgtcagcgtggtcagggcgatgtttggcgtaggtgtaagcggtggagagataaacgccctttaacgcttcatacatggcgctcaccatcatcccgctttcacttcccggtacatccagcccgtcggcgcgtccggtatggtgccaggcgcgagcggcaaagttaggggtaagcagtcccgtcagatagagttgccctgtgccgtcggtgatttccagaccgttcatccaggtgatgccttcggcaaggtcatactggatgtaaccgttcatcattgccggataggtgtatttgtcgtcgtagcgatcgtacttgccaaaatgtagccaggctttgctttcgtcatgatgtccggcaggtgtggcggtaacgctataacgaaagttgccgcttaagttctgcaccttcagcgcggtcataatgtcgcgggtattgggaatgacgtagcccagatcgggcgtgaaatcgccccaccattgcaggtcatccagcgaggaatcctgacgcagactgagcatgatttcggtgccatcattggttcgataaccgccatagaaacggttaatcccaccttcgaaccccccccagctatggtcaggcacccaggcattaccgtcgtggtcggcctgtacggtccagccttcgccgtaaatcaggccgaaccaggagccgtacttcatctccaggccaccttcaatataggtgccgtcgctgtatttatgtttattctcaccctctaaatccatatatccaccaacccctaattcgccgtaaaaacgaaatgaaggagaagatgtcgaggtaatggcgggtgtttttgtgtcgtcatgttctgccggacgagcttcttcagcgaccgcagaaaacgcgtagcaaaacggcagagcaagtaatgctctgcatggtgcagtgattaatttcattgtgttaatccatgagctaaagaaaaagtacagccttttatcgttgtaattataaaaatataaaggcagaaactattttccctctccccatccaggaagagggaaaatgcctgctcattttttattaatctgcttaatcaacattgctggctggcgtcgcttcaatatggcgctcttcagccgttaatccctttatatatttactgtatttccaccacgcaaagccgaggaagataacaataccgccgacgttataaaaaatgatggtcagaatattcgcgccagtcgggaatgtcgaagcgacaaaccctacggcaaatatcgcaatcagcattgaaacaacgataataccggtgcggcgggagcccatacggaaatcacgtggcaggtgatctaatttggcgcgtaaattcaggtaagccagcatgatgaataacggcggaagcatggacgctgcggcggtcatattaataatagtattcatcagatcctgcacagtattggaaccgagcatcgggataatcatcagcgggataacgatcaggaactggatccacgctgcacgcgccggaacgccgttttcgttaagttcgacggttttcttaccaaagatgccttccgggatttcggagaagaaaattttcaccggcgttgcggtccacatcagcagggaaccgaacatcgcggtaaaggacaccagaccgacaaagcgattcatcaacgcttccggcagaccaaaatacgccgccatgccgtggaatacctgcaccgagccgccagtaaatttcaactctttgctgctgacgaagacgttaatcagcaccgaggagacggaatacagcacaccgataaaaatcccggcgaggatgatcactttaacgaacgatttcgaaccgcctttgacgtcgttaacgtacaccgcgacggactccgcgccacctgcggccataaagatccaggtggtaacgccgaggaacgcccagttgaagttcgggatcatcgcgtcaacggtgatcggatcggcaggctgtacgccgccaaccagtgccgtacctgccagtaaaatgtaggagagcgttaacagcagcatcagcgttgaagtgacggaggtaattggccccagcattttcgccccgttggtggaaacccaggtggagaaggcgaacagcaccatactgataatggtggtggcaaccggcgtcataatatattcgtagccgaggaaggcatacgaagcataagcaataacgcgcggcaacagcgaggtgaaaaagaacaggtttacgaaccagtaggtataggcagtaataaatgcccaacgcccgcccagcgaactttttacccacgcgtagacaccagcttctgagtttttatttaacgaaacaaattctgcgatgatcagacagaagggaataaaataaaaaatcgtcgcgaggaaaaacatcggtgccgaggccagtccaagctcaatattattattgataacgttgttaaagctgtaaacggcggcaaaagtcagcgagagcaagccgaatttgccgattgtattacgtttggtatcagacataacacatctccgaaaatgagtagggtagcggcggcggcaaactccttttgccgccgtagttgttatttgttatggaaataaccatcttcgatggtgactttgagaaccacttttttgaccgcgttattgcagataaaccgatatgcttcatggatatcgcaaataacgatttgcccttcgtggacctcaacggtttctccgcagccttttaaatattcacggtcagtttcatcacgataatattccacgacctgtaatgtctctttcggcgcatattcaattttttgctgcccttgcaggtagtaatgcacttcaaaatagcgtcgatgcccagtaaatagcgcatcggtcgcggagtctgtctccacgcggtaagtcaatgagtcaccgatggagtgggcgacgccaggctgaatgttgtcgatattttcaatcgcttcaacgcagcgttgccacttcttgccagaggcgtaaatctggcggaactgttctaagttatcgatgatcctcattgcttattctcgctgtgcaaattcgtggaaaagaaccctgcgccgaactcatacgacgccaggctttgcgcggtagcttctccgccagaaaccggcagcaacgtaaagccgtagctgaagtcacggaaccagacgcgccaggagtccagcacctcgctgccccaggagttagagccgaggccaagcagctggtggtcgagattcagggtgatatcatcactgcgctgcagctcgttacagtgctgggcagcgtggatgttttcctgggtatagtgccaggcgctgaagttaattgggcgctgcggaaccaccagcagaccgttgccgtggcggttagtgagtgccgtccagcggacatgctgacggttgccgttgttctgtgggaagggatagttctcgaacatggcatcgacggtgctgcgccagatatcgatgatgttagcctgctggctgtcggcgtagttttcgcccggtccacgaccgtaatacgccacctgatcgtattcgccgttaatccccatggtgaaaccgatgcacggaatgatgtgcggatagtcgccgtaacgctcgccggaaagcgccacattaacctggccatcggcagcgatgcgccagatgtaggtgcagcgcatcccgaagtcaaacaccggtggggcaataaccgtgcggctgatgatcaacacttcaccatcgctctgttctacggcaaagtcgcgcagatgttcctgcatgatctgcaaatgattcggctgccacagcccttcgtactcctgcttgtggttgtcgatcattggcttgaagaagttgatttttggctcgcgggtcagcagcgactcgccattcacctgccaggatgtcggtttgccactcatttttgagaaggtgatcgcgaagttgtagccgcgaacggtgcagctcaaacgatcgtcttccagcgtcagcggacgcgcattatttggcgcgaaaggtacaggctgcgcggtattttccttcagcgggaactgataagtggctatagggtgtccggcttcgctgtagcgggtgcgggaatctttggtcaccgtaatgttgaggaacgcttcgcgggcgtccagctgtggcagcgtgatctgcaagggggcttcgctgttcggcgcaacgtcgcgcagtttaatctgctgcgtcgcgagcgtttcaccttcggcgcgcacctctgcgtgcagggtgtagtcatcaagcgtggtaaaccacagtttattttcgactttcaactcgccgcgagtcagatccaacgcgtggatttttaccggcgcgataacctgtttgtactctttcaggccaggcccaggcgtctgatcggaatagatcaaaccatcaagacagaagttatagttgttgggatagtcgccgtagtcgccgccgaatttataccagacattgccgttgtcatcctgcgcctggatcccgtggtcgcaccattcccagacataatgtccctgaatgcaatcgtgcttatagaagacgttctggtactccgtcagcccgcccggtccgtttcccatcgcatgagcatattcacagatgatgcgcggcttcggatgcgggtattcaccaaactcattcatcagcggcacgcgggtgtacatggtggaaataatatcgaccacttcagcatcgcgatcttcttcgtagtgcaccagtcgcgtgtcatccagcgccttcgccgcgtggtacatcgcgcggatgttacagccatagccggattcattgcccagcgaccagatgatgatcgacggatggtttttctgcgcgtgaatatggcgaacgatgcgctcgacgtagacgttttcccactgcggatcgtcggtaatacggctgatatcgccgacattggcaaagccgtgcgattcgacgtcggtttccgccatcacaaacaggccgtagatatcacacagttcgtaaaaacgcggatcgttcgggtagtgagcggtacgtacggagttgatgttgtgctgcttcatcaactggagatctttctcgacgcgatccatcccaacggcgcggcctttgcgatgatcgttgtcgtggcggttgacgccgtgcagcatcacataacggttattgatccagaacagaccgtcgcgcactttgatatcacgaaagccaacgcgttgcggcaccacttccagaatgttgccgtcggcgtctttcagcgtcatgaccagatggtaaagataaggagactctgccgaccattgctgcggctgttcgacagtaaacgcaaagctggcgctggtcagtttttcaattgccagatgatcaatggagctgctgtgcaccacacgctcgccgtcgaacaggctatattccagcgtcgttgcgacaggggaggcggcgagattttccagcaccacttcgcaggaaagcgtggcatcgcaataggcttcgtcaaagtcggtacgaacggtgaaatcgttaatatgtgttagttgttttccgatcagataaacatcgcggaagatccccgctgaccaccacatatcctggtcttccacgtaggtagagtccgcccattgcatcacgcgcacacacaacaggttgtcgccggttttaaccatcgcgctgatgtcaaactctgcggtcaggcgactgcccttgctgaaacccacatactgaccgttaacgtagacttcaaaataggtttcgacgccgtcaaatttaatcagcgtctgtttaccctgccagccgtcgctgagggtgaaaatacgttgataggcaccggttgggttatcgctggggacaaacggcacatcgatagggaacggaaaaccttcgtcggtatattgcagtttgccgtgaccttccatttgccacatggcggggacggtaatatgcccccagtcagccattaactcagaggtgaaggcttctggcacttgcagcgggtggtcaaaaaagtggaaattccactgaccgcttaagggcagaaacaggctgctggtttcgcgggcaaaggtacgcgcttgcgcaacagaatcatatgaaaaaaagtacgcacgcggcgcaagtcggttttcgtgggtgagctgaatgttttcccagcgattcatagggcctcccggtagagagaaatcggaaccattcatggtgatggtagtttgtgtaattgctggggagtttagtaaaatttttactaaaaagtagcgggtaaatgcatttactttaactggatcacgaaaataaacggcagcactgtccggcaaaaacgattgccggacagtgtgtaaggggatttagcgggtcgtgccgcgcagttttaatttgctgggaacgaagactaacagcggcagcgcgcgaccatcgcgagccttttcatacaacaggttaacgccctgacttcccatcatctcggaatggatgcgcacggttgagagcggcggaaaggtaaatcgcgcggtggggatgtcgttcacgctgataagcgaaatatcctgtgggatgttcaggcctcgttcatgaattgcccgcagtacgccgatagcaatggaatcagaagcgacaaacaacgccttcgggtagtcttcccgcgccaacatttgttttgccagttcatagcccgacgaactggaaaagcctccgcgccagatatcctcttcgcgtaccacttgtttcagtcggccatattccgcaaaggcgacctcacgaatatccgccttgccaggctcatcttcaccgccaataaaaccaatgcgattaacgccctggttgatatagaagtcgatgatttctttactgatgcgtgccagatcgatatccaccgcatcgtaaccgctgccgggttcgtgaaagtcgataaaacagatattgtcggtcaacgcacaggcggcggcgcgcagggcgggcgtgggtttgccgacaattaaaataccggtgacgtttttaatgtctggtaatccgctgtgttcataacagttggtcagttcgatcgccagcttttcgcactgagtttcaatgccgtggcggatcgccagatagtaaggatcgttgatctccagctcctgttggtagctgtagatagccagaatatggtgttggttgactgcacctgtctggagtttacgggcactactggtcttgtactccagcttttcggcgatctcgagaatgcgatgtttcgtctcttctttcacattcaatgtcggatcgtcatttaagaccctggatactgtcgccagggatacgccagcttcgattgcgatgtcttttagtgttgccatgtttaccttttttactttccctgatgtgcgcccccattgtagaggaagtgcttatcgggtcacctgttttcagtaaataaagcgcgtttctttgacgctgtaacggtaacacagcggctcacgaatgtgatcacgcctgcattctccatttttagcctacaggattgagaaaaacttttgctatagtttagtaaaattttacccgaagggaggaaacaatggaaaccgtggcttacgctgattttgcacgtctggaaatgcgcgtcggaaagattgtggaagtgaaacgccatgaaaacgccgacaagctgtacatcgtacaggttgatgtgggggaaaaaacactgcaaaccgtgaccagcctggtgccgtactacagcgaagaagagctgatggaaaaaacggtggtggtcttatgtaatctgcaaaaagcgaaaatgcgcggtgaaacgtcggaatgcatgctgttgtgtgcggaaaccgatgacggcagtgaaagcgtgttgttaacgccggagcggatgatgcctgcgggcgtacgtattgtataaaaagatcgaatggcgacgtcgtatcgccattcgacttgatattacgcttcttcgacacttactcgcatggccgccagcgccttacgcgccgctttgatcaccagttcacactgttcaatggtcagtgtcagtggtggttcaatgcggatcgttttagcgttgttgagtgttccggccaccaggacgcgctggcggaacatctcgctggcaaagttatagccgatttcgttatcaacaaactcaatcgccatcaacatccctttaccacgcgcttcctgtaccagatcgggatattcccgcgccaattgacggaaaccgtccagcaacatatcgcctttttgttcagcctgagccggtaagttctgctccagcaacacattgatggtcgccagcgccgccgcacaggccagcgggttgccgccaaaggtagtggtatgcaggaacgggttgtcgaacagaacggaaaacacctcttcagtggcgatggttgcgccaatcggcatcacgccgccgccgagggcttttgccagacacaggatgtccggctgtacgttctcatgctcgcaggcgaacatcttgcccgtgcgccccataccggtttgcacttcatcgaggatcatcagtgcgccgaactcatcgcacagcttacgcacggcggtgagatatcccggcggcggcagaatgacgccaccttcgccctgaatcggctcaaggatcactgcagcaacatcatcaccggtttttttgcactcgctaagggccgtgcgcatggcttcgatattgccaaacggcacatgacggaaccctggcagcagcggcataaatggtttgcggaaggtcgatttcgccgtggccgacagcgcgccaagggatttaccgtggaacgcgccgctggtggcaataaaagtaaacttgccgcgcggtgactgataagccttcgccagcttcagcgctgcttcaacggactcggtgccgctattacaaaagaagctgtatttcagtttaccgggcgtcagtgcagcaagtgtttttgccagcatcgcccgtaacggatcgagcagctcctggctgtgcagcggttgtttcgcaagttgattctgtacggcggaaaccacaactggattacggtgccccacgttgaaaattccaaaacctccaaggcagtcgataaactcctgtccctgggtgtcgacaagcgtatttaaacctcccgcttgccactctacggctccgtaatccccgccggcggtaacagatttgcgatactctaaaaaccccggattgacatgctctttgaagtattcaatcacctctcggttaagtgctttcatctcctcatgatccagcgttcgcttctcaatgagattcagggcgtgggcgctgcacgctaaagccgatgcgctcgaaggtaacctgttcaaaatatgctccggaggctcgcgtatcacatgataccgatttaagtattgcagggattgcgccactccggctgcgatcgcgaaaatcgggataaacacaaatgtggttatcatttgcgcaatatttaatgctatttgttaacatctgttgttattttgcacggtttttgtcgggtatggatttggcgattgctgcgcaaatgcacactttcagggcaacaactgcctgatttttgggcaagataattaacgttttcgtatagtaacagagtgaaagtattttaaatcaagggattagatttatgctttaatcgcaaattgcgatctaaatcaaattaatcagttaaagataaccgcagcggggccgacataaactctgacaagaagttaacaaccatataacctgcacaggacgcgaacatgtcttctcatccgtatgtcacccagcaaaataccccgctggcggacgataccactctgatgtccactaccgatctgcaaagctatatcactcatgctaatgacacttttgtgcaggtgagcggctataccttgcaagagttacaagggcagccgcacaacatggtgcgtcacccggatatgccaaaagcggcgtttgcggatatgtggttcaccctgaaaaaaggggagccctggagcggcatcgtgaaaaatcgccgcaaaaatggcgaccattattgggtgcgggccaatgcggtaccgatggtgcgcgagggaaaaatcagtggctatatgtcgattcgtacccgggcgacggatgaagagatcgcggcggtggagccgctgtacaaagcgttgaacgccggacgtaccagtaagcgtattcataaaggcctggtggtgcgtaaaggctggctggggaaactgccttcattaccgcttcgctggcgggcgcgtggcgtgatgaccctgatgtttatcttgctggcggtcatgctttggtttgttgctgccccggtggtgacgtatatcctctgtgcgttagtggtattgttggcaagcgcctgttttgaatggcagattgtccgcccgatagaaaatgtcgcccgtcaggcactgaaggtggcgaccggagagcgtaatagtgttgagcatctgaatcgcagcgatgagctggggctgacattacgcgcggtagggcagcttggcctgatgtgccgttggctaattaacgatgtctcaagccaggtgtccagtgtcagaaacggcagtgagacgctggcgaaaggtaccgatgaactgaacgaacatacccagcagacagttgataacgttcagcaaacggtggcgaccatgaaccaaatggcggcgtcggtgaaacagaactctgccacggcgtcggctgccgataaactttctatcaccgccagtaatgcggcagtgcagggcggggaggcgatgaccacggtgatcaagacaatggacgatatcgccgacagtacccagcgcattggcaccattacttcgctgattaacgatattgcgtttcagaccaatattctggccctgaatgcggcggtggaagcggcacgagccggcgaacaaggcaaaggttttgcagtggtggcaggggaagtgcgtcatttagccagccgcagcgccagtgccgccaacgatattcgcaagctgatcgatgccagtgctgataaggtgcaatccggttcgcagcaggtacacgcagccggacggacgatggaagatattgtggcacaggtgaaaaacgtcacccagttgatcgcccagattagccattcaacgctggaacaggccgatgggctttccagcctgacccgtgcagtggatgagcttaacctcatcacccagaaaaatgccgagctggtggaagagagtgcgcaggtgtcggcgatggtaaaacaccgcgccagccgactggaagacgcggtgacggtgctgcattaatcgatatgccgcatccggcggttggcgcacaatgcctgatgcgatgcggcgcatcttatcaggcctacgggggggtagggcacgccacatccggcaatcggtgattaatccagttgcgtaatatcaaaagcggcgcggtcgatcaccgcaatgatcttttttatttgtgcatcagtgatatcgctctggttgacgcgtaaatccagcaccgctttaaaattatccagcgcccgcttcatttgcgggttctggcggagtgcagcaccaacgcaacgcgctttgatgcgttcttcgatcatctccacctgttcgcggttttcttccagccactgcgcgccctgttcggtcaacgcaatctgcttcttaccaccttcctcttcgcggatggtaatcagcgactgctcctgcagaaaatccagcgtcgggtagatgacacccgggcttggggtgtaattcccctgggttagattctcaatcgctttaatcaattcgtaaccgtggctgtcatcgcgcgagagaatatccagaatcaccagacgcaattcaccgtgaccaaagaaacgctgccgacgaccgccgccgcgaccgtggcgaccaccgcagcattgaccgtgttcatgctggtgaccgtgtccgcagtgctcatgttctgacttctcacctttgcagcagccttcatggcgtggctggccttcatgtttacaacacccttcgtgatgatggctcatatcagcctccttttgcttaattagatatatctaatttatatctgatatgagcgcttttgcaagtataaaaatgatttttaaacgtgaatacacctcacatccaggccggataattcgttcacgccgcatccaacagccttgctacgacgctgaatgtcttctcatacttcagatatatcagttctacaaatcgcttgcatttatcatgattaacaatcattatcatttgcgaaatttatttagatatatctgattactatcacgaaggcgataacaatgaataactccccccgctacccgcagcgcgttcgcaatgatctgcgcttccgtgaactgactgtgctacgcgctgagcgtattagcgccggttttcagcgcattgtccttggcggcgaggcgctggacggttttacatcgcgcggctttgacgatcacagcaaactcttctttcctcaatctgatgctcactttgtgccgccaacggtaacggaagagggcatcgtctggccggaaggaccacgcccaccgtcgcgtgactatacgccgctgtatgacgaactacgccatgaactggcgattgatttctttattcacgaaggtggcgtcgccagcagctgggcaatgcaggcgcaaccgggcgataaactcacggtggcaggtccgcgcggttcgctggtgatgccagaggattacgcgtatcagctgtatgtctgcgatgaatccggaatgcccgcactgcgccgccgcctggaaacgttgagcaaacttgctgttaaaccgcaagttagcgcgctggttagcgtgcgggatcacgcctgtcaggattatctcgcgcaccttgatggttttaatatcgaatggctggcacatgatgagcaggcggtagatgcgcgtctggcgcagatgcaaatccctgccgatgattacttcatctggataaccggcgaaggcaaagtcgttaagaatttaagccgccgctttgaagcggaacagtatgatccacagcgggtacgtgcagcggcttactggcacgcaaagtaactgatatataaaaagaaaaaggctgacgatttctcgtcagcctttgctatatctggtggcccctgctggacttgaaccagcgaccaagcgattatgagtcgcctgctctaaccactgagctaaggggccatggtagcggattataaagtaactccgtgtcgcaatccagccattaccgcgcgcctgctgtttttataaacaatgtattttcaatccgttatacttttcctggtgatgttagaaaggagtaaatatggttgaggatattttggctccagggttacgggtcgtgttttgcggtatcaaccctgggctttcatccgccgggactggttttccctttgctcatccggcaaatcgcttctggaaggtgatatatcaggccgggtttaccgaccgtcagttgaagccgcaggaggcacagcatctgctggattatcgttgtggcgtcaccaaactggtagaccgtccaacggtgcaagccaatgaagtttcaaagcaggagctgcacgcaggcgggcgtaagctaattgaaaaaatagaagattatcagccacaggcgttggcgattctgggcaaacaagcatatgaacagggattcagccagcgcggtgcacagtgggggaaacaaacgctcaccattggttcgacgcagatttgggtgctgccaaatcccagtggtttaagtcgcgtttcactggagaaactggttgaagcgtatcgcgagctggaccaggcgctggtagtgcgtgggcgataaaaaacgccaccgaaaaggtggcgtttgtgcagagggcctagtgccgggtgcggcgtaacgcctgatccggcctaccgattaatcgtccaggaagctacgcagcacttcagaacggctcgggtgacgcagtttgcgcagcgccttcgcttcgatctgacggatacgttcgcgggtaacgtcgaactgtttacccacttcttccagcgtgtggtcggtgttcatatcgataccgaagcgcatacgcagaactttcgcttcacgcgcggtcaggccagccagcacgtcgtgcgttgccgcacgcaggctttcggtggtcgcagaatccagcggcagctcgagggtggtatcctcgatgaaatcccccagatgcgaatcttcatcatcaccgatcggcgtttccatggagattggctctttggcgatcttcagcactttgcggatcttgtcttccggcatcagcatacgttcagccagttcttccggcgtcggttcacggcccatctcttgcagcatctggcgagaaatacggttgagtttgttgatagtctcaatcatatgcaccggaatacggatggtgcgcgcctgatccgcgatagaacgggtgatcgcctgacggatccaccaggttgcgtaggtggagaacttgtaaccacggcggtattcgaatttatcaaccgctttcatcaggccgatgttaccttcctgaatcaggtcaaggaactgcaagccacggttggtgtatttcttggcgatagaaataaccagacgtaagttcgcttcaaccatctctttcttcgcacggcgggctttcgcttcaccgatggacatacgacggttgatatctttaacctgctcgatggtcaggccggtttcttcttcaatctgctgcagtttctgcagggcgcgatgcacttcttcagagacatcgtgcagtttttccgaccacggcttgttcatcgcaattgccgcgttgaaccaggtatcgctggtttcgttgccggtaaacagggtaatgaagtttttcttcggcattttgcactgctcaacacagagcttcatgatcagacgttcttgcgtacgaacgcggtccatcatgacgcgcatgctgttgaccaggtagtcaaactgcttcggcaccaggcggaactgtttgaatacttcagacagtttcaggatctcttcctgagcggcagcgtgactgcgacctttcgctttgatggtgtcacgcgttacaacgtactgagcgcgcagttccgcaaatttttcacgagccagttccgggtcgatgctgttgtcatcatcggcgctgtcgtcatcgccatcttcttcgtcttcatcttcgtcatcgtccagatcttcctgggaaagctcagaaccgacgtgagtggcggtaggtgccagatcttcttctgcgttcgggtcaacaaagccggtgatcagatcggacagacgcgcttcttctgcttcaacacgatcgtactgttccagcagataggtgatcgcttccggatattcagcaacggagcattgaacctggttgatcccgtcttcaatacgcttagcgatgtcaatttcgccttcgcgggtcaacagttcaacggtgcccatttcacgcatgtacatgcgtaccgggtcagtcgtgcgcccgatttcagattccacgctggaaagcacctgcgcggcggcttcggcagcatcttcgtccgcggtgttttcagccagcatcagatcatcggcatccggtgcttcttccatcacctgaatgcccatgtcgttgatcatttggatgatgtcttcgatctgatctgaatcgacgatatcttccggcagatggtcattgacctcggcataggtcagatagccttgctccttaccacgggtgacaagaagtttcagctgtgactgcgggttttgctccataagacggtatccacacttatttcatgaggttggtgttgggcgattgacccgatgtccttcagccgttaacgctgaaatccaacggttgtttaccgccaacgataattacgagggcgtacttatatatttgccgctgcctctcagtgcggctgtcgggggcttcccgatcgctcttcggcacttaagccgttaaatcactttttcgccagctcctggtttaatgtccagagctccaggcgttcttcgttgcttaaaccatgcgtgcgctcacgagcgattaactcttcctggcgcagttcaagcagcgaatcaaacatatggttgagtgagtcggtgaaggtttgctcagcaatattcttatctgctatatcgtcccacatcgacagtttttcaagggtggcagcattatttgtaccacgatagtgctctaaaagttgcccggtggtcagacctggctgagagagacaagtgttgaccagttctctgaataagccaagtccagggagcttattttcatccagattctcaagcggcgggaccaacgtcgctaattctggattttgcaccagcaaccctataagtatacgcatggtcgtgcgttttagctgcggaacagggcgagaaacgccgctctctgccgcttttggcattaatcgttcaagctggctgtcatcaagtatgcctaatttgttgcctaattcctgacgaagatatattcgcagcgtttcgcccggcacttgcgatatcaatggcagtgccagcgtactcaaacgtgcgcgcccgtcaggggtactcagatcaacttgcggcatcagactgttaaacagaaatgcggagagtggcatcgcctgctccatccgcgcttcaaacgcttctttaccttcttttcgtaccagcgtgtcagggtcttcgccatcaggcaaaaacataaagcgtagctgacggccgtctgtcatgtaaggcagcgccgtttccagcgctcgccaggcggcatcgcggcctgcacggtcgccgtcataacagcaaatgacattgttggtcgcgcggaacaacagttgtatgtgatcggcggtggttgacgtacctaacgacgcaacggcgtaattaatgccgtattgcgccagcgccaccacgtccatatagccttcgaccacaagcagacgattgggttcagcgttatcctgctgcgcttcataaagaccgtaaagctggcggcctttatggaaaatgtccgtttccggcgagttcaggtatttgggggtatcgttgcccagcacgcgtccgccaaaaccaatcacccgaccgcgtttatcacgaatggggaacatcacccgctcgcggaaacggtcgtaactgcgcccctgatcgttagtgaccaacatccccgcatcaatcaatgactggcgattttctggattgccgccaaaccgcttcaggacgttgtcccagccggggggcgcaaaaccaatcgcaaagcgggcgataacctcgtggcttaatccgcgtttttccagatactggcgcgcagacgtggcaacaggttgttgtaaagattgttggtaaaacgtattcagaccgtccatcaactgataaagcgtttgccgctgatggcgctcgatctggctggggccgctgcctgcttcaaatggcacttcaagattgtgcattgctgccagctcttcgaccgtttcgacgaactcgagcttgtcgtagttcatcaggaagtcgatcgcgttgccgtgcgcgccacatccaaagcagtggtaaaactgtttctcaccgttaacggtgaatgacggggttttctcgttgtggaatggacaacacgcgtggaaattcttgccctgctttttcagctttacacgggcatcgatcagatcgacgatgtcagtgcgtgccagcagatcattaatgaatacgcgtgggattcgtccagccataggccccgatttttagcaattcataaacgaaaataagccgcgcattcctttcggaagcacggccttacaactacaactcggtctgatcggagagcaacgctctcggggaattagtacagacgagtgcggcgtgcgttttcgcgagccagtttcttcgcgtgacgtttcactgcagaagctttagcgcgcttacgttcggtagtcggtttttcatagaactcacgacgacgaacttccgccagaacacctgctttttcgcaggaacgcttgaagcgacgcagagctacgtcgaacggctcgttttcacgtactttaattaccggcatgtgcctctcacctttgattaattcggtttgccgctggcatcaacgccagcttatttcaaaatggtgcggaattttactgcaattgctgctgctttgtaaagcaccgcggccttttttgaaagggacttttataagggtgaggagtatacacgaggctttctccaggggcgaacaaagttttacatcaacccgcattggtcctacactgcgcggtaataaagcgaggtaaaacaagtcatgcgtgtactgggtattgaaacttcctgcgatgaaaccggcatcgccatttacgacgatgaaaaaggtttgttagccaaccaattgtatagtcaggtgaaattgcacgctgactacggcggcgtcgtgcctgaactggcctcccgcgatcacgtgcgtaaaaccgtaccgttgatccaggcggcgctaaaggagtctggtttaacggcaaaagacattgatgctgtggcctataccgcaggccctggattagtcggcgcgctgctggttggcgcgaccgtggggcgttctctggcgtttgcctgggacgttccggcgatcccggtacaccatatggaagggcatctgttagcgccgatgctggaagataacccaccggaatttccgtttgtggcgctactggtttccggcggtcatacgcagttaatcagcgtcactggcattggtcagtatgagctgctcggcgagtctattgatgatgccgccggggaagcgtttgacaaaaccgcgaagctgctggggctggattatcctggcgggccattactgtcgaaaatggcggctcagggtactgccgggcgctttgtcttcccgcgcccgatgaccgaccgtccggggctggatttcagcttttctggtctgaaaaccttcgcggcaaataccattcgtgataacggcaccgacgaccagacgcgtgctgatatcgcccgcgcctttgaagatgcggtggtcgatacgttgatgattaagtgtaagcgagcgctggatcagacgggctttaagcgactggtaatggcaggtggcgtgagtgctaaccgcacgttacgggcgaagctggctgaaatgatgaaaaaacgccgtggcgaagtgttctacgcgcgtccggaattttgtactgataacggcgcgatgatcgcctatgccggaatggtgcggtttaaagcaggcgcgacggcggatcttggcgttagcgtgcgtccgcgctggccgctggcagagttaccggccgcgtaaaactcttaggtgccggagagtcacttccggcaccgtcctcacttaaagcaacaccacgggcatccacagtaagccggtaatcaccagcaacacgaggaatatcagcccaaaaattgcccccagtcgccagtaatccaccgttggcagataaccactaccgtagtaaatcggactgggtccggtggcgtatggcgtaagaatgctccccagaccaattgccgcgccaaccatcaggcagaacaccggcagcgggatttccggcatcgccagcgcggcggcaatcatcatcggcgcgagagcggaggtatacgccgtggcgctggcaaagaagtagcgcagcagataaaagaccacaatcaacgccaccatcaccatcgtcggcgaataaccgcttaagctgcctgctaacagtttgccaaaccagctaataaaaccggtgttgttgagtccggtagcgagggtgataagcgaggccagccagaagaaaacgttccacgcggctttattactgacaatgtcgtcccaactgataatgcgcagaagcagcatcagcgccaccacgctgtaaccgaccatcgcggcatcgatataatcaccgccgaaaatccacagcaccagcgcgcctaccatcagccccagcatccgtttttcacgcgaacagagcgggcccattgcctgcagttccgtctctgcccagcgcggcacctgatcaccagacttcagtaccggcgggtacagcacgtaagccagccagggaaccagcagaaccagtaaaatgctgagcggcaacatcccgaggaaccagtcgccccagctcagcgtggcgtgagatgcgcttttcatcaggccaattaacagcaagttaggtgccatcgccgtcaggaaaatggcgctggtcacgcagtcggcaacaatccccatccacatgatgtacgagccaatgctgcgcgaactgctgtcgtttggttgtgattgatagagcggtggcaggttacggatgatgggatagataatccccgcaccacgcgccgagttggacggtgttacaggcgcaagtatcagctcggagaacatcactgcatagccgagaaacagcgtacgatgccccatctttttcaccagaatcagcgcgatgcgacgtccaagcccggttttttcatagcccgtaccaaacataaaggcggcgaaaatcagccagataaccgaattagaaaaaccagaaaccgcccaggagagggatttggcggtgaacttaaaacctggctgggcgagctgctccgggctgaacagcagcaagggagagagaatggcgataatggagatacccaccatcgccaccacggcacccggcacgggttcgaggatcagtccaacgatcacgccagtaaaaacagcaaagtagagccaggtatgactctccagccctgcgggaagcggaagtagagcaataatggcgatgaccgccagcggcgcaaggtatcgccaccattcagtggaaggtttcatcgtgttatgcctgcgaaaaaggagagggggtgagcctctccgggagggttatttgatgtagtggacgtgctcgcaaatctcttccacgatgggatcgcggcgttcggcgaacagctttttgttttcggctatcaggttgttgccgtgggtatcaatagagacaatcagcgggccgaactctttgacccggcagacccacagtgactccggcatcccgagttctgtccagtgcacttcttcaatctcttccacctgggttgccgccagtactgcgcagcctgccgggaaaatcacatgtagcgccttgaatttctggcagccttcttcggtcagcggccccattccgcctttgccgaccaccagtttcacgccggtctgttcgataaattcacgttcaaaactttccatacgcatactggttgtcgggccgacggataccatctcccatttgtcgccgtttttgcgcacgatggggccagcgtggaaaatcgctttgccgttgagatcgtaagggatcggacgtttcagttcgatcaagcggcggtgacaaacgtcacggcaggtcaccagcgtaccggtcaggtagatcacatcgccgacgcgaatatcttgcagatcttcagctttgatcggggttgtcaggatctttttcataacgcgctccgggtgtgagacagattttcaaaggagagatcggcatgaaccagcagtgtgccgcgacgatgcgcccagcagcctgtagaaacagcaacgccgatggttgacggatggcgagcggcagattcgatatgcacgcccatcactgaactgttgccagtcagcccttgtggaccaatccccagacggttgagtccttcttccaagcgtagctccagctctgccgctttcggattggggtggcggctgccaattgggcgcaaaatggctttacgtgagagcatagcggcggtttccaccgaggtggcgatgcccacgcctaccagtaccggtggacaggcgtttacggcgagggtggagatattttcgaagacgaatttcaccacgccttcgtagccttccgacggcattaacactttcgaacgaccaggcaacgtgcagccgccgcctgccatgtaaacttcgatttccgcatcgtcaccgtcggggacgatatcccaggtgacccacggtacgccgctgccggtatttttgccggtgttcacttcgtcaaaaatttccaccgcgttgtggcgcagtggcgctttgacggttgcttcttccacggcttgcttaagaatgctttgcagctcgccaagcagcgggaaacgggaaccgactttaacgaaaaacatgatttcgccggtgtcctgacaggctgggcgattcaggtcgatcgctttttgcatgttgtcgaacatcgtgtggtagatgattttccccatcgacgacgtttcggcatcctttagctgttttagtttgtccaccacgtcatcgggcattcgggtagaaatcatggcggtaaagttagcgacaatctccgtcaacttattcactgcctgttgcttattactttcgctcatcatggcaactccagtttatgtatttgtctggaaaaattcaccgccacaaactaccactaaaaatgtggttttatattttttgccgccgtgaatatgtaattcacagttcgtgaatcaacgcgaaaataagaatgaatattgcgccagagcagggaatggcaatgttttgcgaaatacactgcgcttatcacaactgcggataattaacgatgctgaatagctggcctttagccaaagatttgcaggtactggtagaaatcgtccacagcgggagttttagcgccgcagcggcgacgcttgggcaaacgcctgcatttgtcaccaagcggatccaaatccttgaaaatacgctggcaacaacgctgctgaaccgctccgctcgcggcgtggcgctgactgaaagtggccaacgttgttacgagcatgcgctggaaatcctcacccaatatcagcgactggtcgatgacgttacgcaaatcaaaacgcgcccggaggggatgattcgtattggctgtagttttggttttgggcgcagccatattgcgccagctattaccgaactgatgcgcaattatcctgagttacaggtgcattttgaattgttcgatcggcaaattgatttagtgcaggataatattgatctggatattcgtattaatgacgaaattcctgattattatattgcgcatcttttgacaaaaaataaacgaatattatgtgctgcacctgagtatctgcaaaaatatccgcagccacaatccttgcaggaattaagtcgtcatgattgtctggtgaccaaagagcgcgatatgacccacggaatatgggagttggggaacggtcaggagaaaaaatcggtgaaggtaagcgggcatctttcctccaatagcggcgagatagtgttgcaatgggcgctggagggcaaagggattatgttgcgttccgagtgggatgtgttgccgtttctggagagtggcaaactggtgcgagtattgccggagtatgcacaaagcgccaatatctgggctgtttaccgggagccgctctatcgcagcatgaaattacgtgtctgcgtggaatttctggcggcatggtgccagcaacggctgggcaagcccgacgaaggctatcaggttatgtagatccaccagaaatcactcgggatccttttcgcgctttcttttgaatttcgtccagatttttgtctcctgacgacgccacagacgctggatgttgtcatggtgacgcagcaggatcaggcaagagagcatcgaaaccgggaaggtgaattgtggcttaaaccaccagacataaaacggagcaatcagtgcactgacaatcgctcccagcgacgagtatccgctcaatagcacggtcagtaaccaggttcccgccattactccggtgagatcccagccaattggtgcgatggcaccaaaagcggtagcaacgccttttcctcctttaaaaccgaagaaaacgggccagatgtgtccaaggcaggcggcgatggcaattaagcctagccagaaggggctgacacctaattcatacgcgccccagacaggcaacattcctttcagaacgtcgaaaatcagtactgctacggctgctcccttgccaccgatacgtaacacattggttgcgcctggattgccggagccgctggttcgcggatcgggcagcccacacaagcggcaaaccagaatggcactggaaatggagccgcagaggtacgcgatgaggatcattccaggcgcgattgcactcataagctgttccgttttgaaaattcgtgttcaacgatgaatctgtggataatacgcacatttcgccggaagtggtatccggttagccaaaaagcaggcaggacgtgatggatattgtatttatagagcaactttcggtaatcaccactattggtgtttacgactgggaacagaccatcgaacagaagttagtgttcgatatcgaaatggcgtgggataaccgtaaagcggcgaaaagtgatgatgtggcggattgcctcagttacgctgacattgcagaaacggtagtcagccacgtcgagggggcgcgttttgcgctggtggaacgtgtggcggaagaggtggcggagctgctgttagcacgcttcaactcgccgtgggtgcgtatcaaactcagcaagccaggcgcagtggcgcgggcggcgaatgttggcgtaatcattgagcgtggcaataatctgaaagaaaataattaattttacagctgttaaaccaaacggttaaaacctggtcatactgcagtagttcggacaagcggtacattttaataatttaggggtttattgatgagcgatatgcactcgctgctgatagcggcaatattgggtgtggtcgaaggattgacagaatttctgccggtatccagcacgggccatatgattattgtcggtcacttgttggggtttgagggcgacacggcgaaaacctttgaggttgtgatccagttaggatcaattctggcggtagtagtgatgttctggcggcgtctgtttggcctgattggcatccactttggccgcccgttgcagcacgaaggagaaagcaaaggtcgtttaacgctgatccacattctgcttggcatgatcccagcggtagtattggggctgttgttccacgacacgattaagtcgttgtttaatccaataaatgtgatgtatgcgctggtcgttggcggtctgttgctgattgccgctgaatgcctgaagccgaaagagccgcgtgcgccgggtctcgatgatatgacctatcgtcaggcgtttatgattggctgtttccagtgtctggcgctgtggccgggtttctctcgctccggggcgaccatttcaggtgggatgctgatgggggtgagccgttacgctgcttccgagttttcgttcctgctggcggtgccgatgatgatgggcgcaacggcgctcgatctctacaaaagctggggcttcctgacaaccggcgatatcccgatgtttgccgttgggtttatcaccgcttttgtggtggcgctgatagcgattaaaaccttcctgcaattgattaagcgcatttcgtttataccgttcgccatttatcgctttattgtggcggctgcggtgtatgtcgtgttcttttgaggtaaagaacagtgtcggatgcgtggaattgtcaacgattgcgtaggccggataaggcgttcacgccgcatccggcaaaatatccaacactcactcaggttttgggcaacgctgttccttccagctggctaccgccgcaatccgccgtcgggtcagctcctcgcgaatctccacacctttaaatcccgcttcaacgacggcttttgtcggcactgactgtgccacttcccaggcttcgcgcaaccagcggccttgcgggtagtccgctgattcaaaaccggttctgccgcgcacatcagcctcactggtcagcgccagttgctcgacacgctgcggtttacgccaggcgtcaatggaatcaaacaatttgacgatggtttttgggttcagcattgggaaggtgtggatgagatcgtgaaactcagccaccagtctggctaaatcgcgaatttcatttggcacgcgcagacgctgacagagttgttccactaacttaacacccgccgggccatgaccatgatgacgcggccaaagttctggtggcgtcagtcctttaccgagatcgtggcatagcgttgcgaaacggacatcgacctgcggactcagcatcgccgccattgagagcgtcattaaggtgtgaataccggtgtcgatttccggatgccacttggcaggggccggaacgccaaacagggcgtcaatttccgggaataaaacgcgcagtgcgccgcaatcgcgcagtacctggaagaacacctggggattgcgggtagtgagggcgctttccgtctctttccacacccgttcaggcgtcaggtgttccagttcacccgcgtgggtcatctcgcgcatcagcgccagagtttcatcggcaatacgaaaaccgaggtgggcataacgcgcagcaaaacgcgccacgcgcagtacgcgtaacggatcttcgccaaaagcgggggaaacatggcgcaacagacgattttgcagatcgcccagaccgttgtacgggtcgataatctcgccgttatcgtcctgggccagcgcattaatggtcagatcgcgccgcttaagatcatcttccagcgtgacatccggtgcggcatagcaggtaaaaccggtgtaaccggaaccggatttccgttcggttcgtgccagcgcatactcttcatgggtttgcggatgcagaaaaacaggaaaatcgcggcctacctgctggtagcccgcgtcgagcatctcctgtggcgtactgccgaccaccacccaatctctgtctttgaccggtagccctaacaatgcatcccgaacagcaccaccgaccagataaatcttcacgccattttcccttcgtcaaatacacaattcctaataataagacagtgcaacgaagaaggcgatttagttcatccagcgatctttgcgtttgcgcgttgggatcaggtgcggcagtaccagaccgagcagcaagccaagccccagcacgccaccgccatacataaaccactgcatgatgatggtgcgctgtttgtcatccagctgtacgctggcggcatcgacctttttctgcgcgacaatcagctcgtttttcagtttctgattttcttcttttaacccgttgatcacgctgtcgctctgcgccactttttgctgcatttctgcggtgcgctgattccaggtgttatcgatattggtgagcttatcagtcagggttttgacctgattttccagatctggcacacgggagcgcaggcttggctctgtgctaagttgtttcaacgggatccaggcggtacggccagagctgtctttcacctgggcataattggtgttggcgtcagtttgtaataaggtcacttcctcgccggcgttaaccgtgcccacgaggcgataatggtctcccggaccgctacggacccaggtattcagttcgtcggaaacatagcgcgtttcttcagcgtgtgagacggcagtcgcgctaagtgcgagtaaagttaatccgatcaggcgtaattttggcatcaggctgtcgttattgtcatggaaagtggaacgatagtagtggcatcagtgtcgctacgcaaagcattcgacatcaatcggaatcctctgtgtcaggtcttgccactgcttcaaacttttacgcccgtcaaattgcccgttgcatggcaatttggcgcaaaatactatctactgacaaaaaagatcgcattaagttcgccgttcatcgtcacttatgtgacataaccgataagtaaaggccatggctcaggaaatcgaattaaagtttattgttaatcacagtgccgttgaggcgttgcgtgaccatctcaatacgctgggcggcgagcaccatgaccccgtgcagttgttgaatatttactacgaaacgccggataactggctgcgtgggcacgacatgggcttgcgtattcgtggcgaaaacggtcgctatgagatgaccatgaaagttgcaggaagagtgacaggcggcttacaccagcgcccggaatataacgtgtcgttgagcgaaccgacgctcgacctggcgcagttaccgacggaagtctggccgaacggcgaattgcctgccgatctcgcttcccgcgtacaaccgctgttcagcaccgatttttatcgcgaaaagtggctggtagaggttgatggtagccaaattgaaatcgccctcgaccagggggaagtgaaagcgggtgaatttgctgaacctatctgcgagctggaactggaactgcttagcggcgacacgcgcgcggtgctgaaactggcgaaccaactggtatcgcaaaccggattacgccagggcagcctgagcaaagcggcgcgtggctatcatttggcgcagggtaatcccgcgcgtgaaattaaaccgaccaccattttacatgttgcggcaaaagcggatgtcgagcaggggctggaagcggcgctcgagctggcgttagcgcaatggcagtatcatgaagaactatgggtacgcggcaatgatgcggcgaaagagcaggtgctggcagccattggcctggtccgtcatacgctgatgttgttcggtggcattgtgccgcgtaaagcgagcactcacttacgtgatttattgactcaatgcgaagcgaccatcgcttcagcggtttctgccgtgacggcggtctactctaccgaaacggcaatggcgaagctggcattgaccgaatggctggtaagcaaagcctggcagccgtttttagatgccaaagcgcagagtaaaatgagcgattccttcaaacgctttgccgatatccatctttcccgccatgccgctgaactgaaaagcgttttctgccagccgttgggggatcgctaccgtgaccagttgccacgcctgacgcgtgatattgactcaatactgttgctggcgggttactacgatcctctcgtcgcgcaagcctggctggagaactggcaggggctgcgtcacgctattgcgaccgggcaacgcattgaaattgaacatttccgtaatgaggcaaacaatcaggaaccgttctggttgcacagcggaaaacgttaatcaggcaaggataaaatcgcttatgaagccgctctcttcaccgttacagcagtactggcagaccgttgttgagcggctgccagagcctttagccgaggaatcacttagcgcacaggcgaagtcagtacttactttcagtgattttgtgcaggacagcgtaattgcgcatccagagtggctgacggaactgcaaagccagccgccgcaggccgacgaatggcagcattacgctgcctggttgcaggaggcgctcagtaatgtgagtgacgaagccgggttaatgcgtgaactgcggctattccggcggcgcattatggtgcgcatcgcctgggcgcaaacgctggcactggttactgaagagagcatattgcagcagctcagccatctggcggagacgctgattgttgcggcgcgtgactggctgtatgacgcttgctgccgcgagtggggaacgccgtgcaatgcgcagggcgaagcgcaaccgctgctgattttaggcatgggtaagctgggcggtggggaactgaatttctcctcagatatcgatctgatttttgcctggccagaacatggttgtacgcagggcggacgccgggaactggataacgcgcagttttttacccgcatggggcagcggctgattaaagtgctggatcaaccaacgcaggatggcttcgtctatcgcgtggatatgcggctgcgtccgtttggcgaaagtggcccgctggtgctgagctttgcggcgctggaagattattaccaggagcaggggcgcgactgggagcgttacgcgatggtcaaggcgcggattatgggcgatagcgaaggcgtctatgctaacgagttgcgtgcgatgctgcgcccgtttgttttccgccgttacatcgatttcagcgtcatccagtcgctgcgcaatatgaaagggatgattgcccgcgaagtgcgtcgacgtggtttgaccgacaacatcaaacttggcgcgggtggcattcgcgaaattgaatttatcgtccaggtattccagctcattcgcggcgggcgcgaaccgtcgctgcaatcgcgctctttactgccaacgctcagcgccattgccgcgctgcatctgctttctgaaaacgatgctgaacaattgcgagtggcgtatctgttcctgcggcgtctggaaaacctgctgcaaagtattaacgacgaacaaacccagacgcttccttctgatgagcttaaccgtgcgcggctggcgtgggcgatggactttgctgactggccgcaactgaccggggcgctgaccgtacatatgaccaatgtgcgccgggtgtttaatgaattgattggcgacgacgaaagcgaaactcaggaagagtcgctgtcggaacagtggcgtgagctgtggcaggatgcgttgcaggaagatgacactacgccagtgctggcgcatcttagcgaagatgatcgcaaacaggtgctgacgctgattgctgatttccgcaaagagctggataagcgcactattgggccgcgcgggcgtcaggtgctcgaccatctgatgccgcatctgctaagtgatgtatgtgcgcgtgaagacgctgctgtcacgctgtcgcgcattaccgccttgctggtggggattgttacccgcaccacctatttagaattgctcagtgaattccccgcggcgcttaaacatttgatttctctgtgtgccgcatcgccgatgattgccagccaactggcgcgttatccattattgctggacgaactgctcgatccaaacactctctaccagccgacggcgacggatgcctaccgtgatgaactgcgccagtatttgctgcgcgtgccggaagatgacgaagaacaacagcttgaggcgctgcgtcagttcaaacaggcgcaactgttacgtattgcggcagcggatatcgccggtacgctaccggtaatgaaagtgagcgatcacttaacctggctggcggaggctatgatagatgccgtcgttcagcaggcgtgggttcaaatggttgtccgctacggtaagccaaatcacctgaacgaacgcgaagggcgtggttttgcggtggtcggctacggcaagctgggcggctgggagttaggctacagttccgatcttgacctgatcttcctccatgattgcccaatggatgcgatgactgacggcgagcgggaaatcgacgggcgacagttttatctgcgtctggcgcaacgcattatgcatctgttcagtacgcgaacctcttccggcattttgtatgaagtggatgctagactgcgtccgtccggggcggcgggaatgctggttacctccgcagaagcgtttgccgattatcagaaaaacgaggcctggacgtgggaacatcaggcgctggtgcgtgcgcgtgtagtgtacggcgatccgcagctcaccgcgcactttgacgcagtacgccgggagattatgacgctgccgcgcgaaggcaaaaccctgcaaacagaagtgcgggaaatgcgcgagaaaatgcgtgcccatctcggcaataaacatcgcgatcgctttgatatcaaagccgatgaaggcggaattaccgatatcgaatttattactcaatatctggtgttgcgctacgctcatgaaaaaccgaagttaacgcgctggtcagacaacgtgcgcattctggaactactggcgcaaaacgacattatggaagagcaggaagcgatggcgctgacccgtgcttacacgacgctgcgcgatgaacttcatcatctggcattacaggaattgccgggccatgtgtcggaggattgcttcaccgcagagcgtgaactggtgcgggcaagctggcagaagtggctggtggaagaatgaagtatggtattatcgcgcgcaaattttgaatctctcaggagacaggaatgaaagtaacgctgccagagtttgaacgtgcaggagtgatggtggttggtgatgtgatgctggatcgttactggtacggccccaccagtcgtatctcgccggaagcgccggtgcccgtggttaaagtgaataccatcgaagaacgtccgggcggcgcggctaacgtggcgatgaatatcgcttctctcggtgctaatgcacgcctggtcgggttgacgggcattgacgatgcagcgcgcgcgctgagtaaatctctggccgacgtcaacgtcaaatgcgacttcgtttctgtaccgacgcatccgaccatcaccaaattacgggtactttcccgcaaccaacagctgatccgtctggattttgaagaaggtttcgaaggggttgatccgcagccgctgcacgagcggattaatcaggcgctgagttcgattggcgcgctggtgctctctgactacgcgaaaggtgcgctggcaagcgtgcagcagatgatccaactggcgcgtaaagcgggcgttccggtgctgattgatccaaaaggcaccgattttgagcgctaccgcggcgctacgctgttaacgccgaatctctcggaatttgaagctgttgtcggtaaatgtaagaccgaagaagagattgttgaacgcggcatgaaactgattgccgattacgaactctcggctctgttagtgacccgttccgaacagggtatgtcgctgctgcaaccgggcaaaacgccgctgcatatgccaactcaggcgcaggaagtgtatgacgttaccggtgcgggcgacacggtgattggtgtcctggcggcaacgctggcggcgggtaattcgctggaagaagcctgcttctttgctaatgcggcggcaggcgtagtggtcggcaaactggggacatccacggtttcgccgatcgagctggaaaacgcagtacgtggacgtgcagataccggctttggtgtgatgaccgaagaggaactgaagcttgctgtggcggcggcgcgtaaacgcggcgaaaaggtggtaatgaccaatggcgtctttgacatcctgcacgccgggcacgtctcttatctggcaaatgcccgtaaactgggtgaccgtttgattgtcgccgtcaacagcgatgcttccaccaaacggctgaaaggggattcccgccccgttaaccctctcgagcagcgtatgattgtgctgggtgcactggaagcggtcgactgggtggtgtcgtttgaagaagacacgccgcagcgcctgatcgccgggatcttgccagacctgctggtgaaaggcggcgactataaaccagaagagattgccgggagtaaagaagtctgggccaacggtggcgaagtgttggtgctcaactttgaagacggttgctcgacgaccaacatcatcaagaagatccaacaggataaaaaaggctaaccggaaagcggttcacagatctcgcttcgaacctggcaggcctattgacgctgtttttttttcaacctaaagtaaaggaacaagggtgagggaggatttctcccccctctgattggctgttaataagctgcgaaacttacgagtaacaacacaatcagtatgatgaccagcttcatcataaccctttccttatacaaggccccttcttcgggaggggctttcccgtttcagccccttgctgactccccgattgttgatgagcgccagaccccgcgcaatgctttccctgatgcagttttgccttccccgagccgtcacgcaaaatgctgcaacagcctgatcatttgcaccttttagcggaacgcagatataaaaaatccccggctttttgggccagggatgtgggatagagaaaccttcttgacgctgattttttttcaacctaaagtaaaggaacaagggtaagggaggatttctcccccctctgaattggttgttaataagcctggaaacttactagtaacaacacaatcagtatgatgacgagcttcatcataaccctttccttctataaggccccttcttcgggaggggctttcccgtttcagccccctgctgactccccgattgttgatgagcgccagaccccgcgcaacgctttcccagaggcagttttcccttccccgagcggtcacgcaaaatgctgcaacagcctgatcatttgcaccttttagcggaacgcagatataaaaaatccccggctttttgggccagggattattcatagaagagggtttactctgttttttcttcgacgggagttgttgatgttaagggtgaagtcaatgccgccagcgagccgccagaaacaccgatttcattgagcaaggagtcaatcagtggtgcctgtgtgcggtaagaaagggcggcagacaatgcctgttctgccaggtttccgccactaacgctgcctgatgccgcattccccgcagcgccacctcggtttaatccatcgacctgaataatcttgatgccgtcaatggacttcatcggctcaacggatttctctattaccgcaggtaatgattgtaatagcgccagtttgaatttaaggctggtttgctcgtcagaaagtacgttgatagcgtcgttcagcgcacgttgcgcttctgcttccgccagaccctttttacgcgtagcttcggctaactcaacgattgccgccgcctgcatctctgcggcttctttttcagctttcgcccggacggtcagttcgactgctttggtttccgcgtcctgcgcggcagcgattagggcaacttgtttagcacgatcggcttctgcggtctggcgagtggtttcaacgttttgctgggcgcttaccgcttctgcaagtgcaaggttggcacgcgcttccgcttgtgactgctgttccgatttggcggcaatagcgatcgatttcgtctggttggcgatttcggtgacctgctgctgttcgatctctttaatgcgaacttcacgttcagcttcaacttttctggaacggacggcctgttcgcggtcgatttccgtttcctgaatctgtcgttcagccagaattcgcgtctgctctgcttcccgacgacgctcggcctcaaaagccgcaattttcgcattctgctcagcggtacgggttttaacctgctgctcctgctcaagcgtcataaacgcttcttgttgttcaatctccagcttgcgcgaaagcgcatcacggtttttctcacgcaccgcaacttctacatcctgttcaacttcgttacgttcgcgacgacggcgctccgtctcctgcgtcagcttggttaaaccttcggcgtcaaaggcgttgttaggattgaaatgttctttcgacgtctggttaaagttggtaagtgaaacgctttccagttccaggccgtttttcgacagatcttcagctacggtattttgtactccctgcacgaagttctcgcgggtatcctgtaactcatgcatggtcatttgtgcagctgttgcacggagggcatcgacaaatttatcttcaaccaacatacgtaagtcttcaggcgacagggtgcgttgtcccagcgtctgggcggcggtggcaatcccttcaactgaaggttttacccgcacaaagaaagcgaccacgacatcgacgcgcatacgatctttcgtaatcaggctatcaatggttgagcggctgacttccagcttcagggtattcatattgatggggattatttcatgaaagatcggcatcacgattgcgccaccgctcattaccactttttgcccacctaaaccagtacgaacaaaagcttgctctgccgaagcgcgacgatagagcctggcgaaaataattccaataataaacagaatgcatacggcaataattgcggtaaacatccaggagggcacagaattaacaatatcatccattattaaatttccttttgattaataaattacaatatttggggccagggattgttttccgccaaatatcgcgttgcagaaagtcggcaaataattaacactttgtctcctttagtgaaaatttttccttcttcaggctccagtagtaaataatgtatttggccaaattgatcggtgagttttccttcgcagggattacctgaagtcgcttgatgtccggtaattaacgccatgctaccaatatattcttcttctgtaatagctgaactatggtcgcgtggaatccagggcgcaactattttaccggtataatgcaccgcaataatcgtaaacagtaaactgacaggaaccacgaacaggttcgagagtggtgattgccagaccatgatgcaggtatgctgcaacaggatgccaataagaccaaaaaaaccagccagtaagcagagaacgacgagagctggcaatcttccgatattgagataatgaagtgcctggctaatatgacctgtggttatggaatcataatggtcaagatgtgcatcaagagcaccggagagcatatgaccgcagataagcgcaaaaatttctaaaaggccgatcaacagtacaaaggaaatagcgaaaagataaggggtgttatagtcggcgaataaaatcatatgtcactccaatgtccatttagtgacgcaatatttactttaggatagtttccttgcttacatttatctttgttaataataacacatgttagagaagttctggaagagaaagtcttttaatatggttttttatttttcactaaaaagtgtgatcggggacaatatatttacgcacgttatgtttaaaggcactacactgattggggaatactgaaatcagaaaaagcatatggccttaaaaggtatgcgataaccggaggatgtgcttatggatcatagtcttaattctttaaataatttcgatttcctggcgcgtagttttgccagaatgcacgcagaaggtcgcccggtcgatattctggccgttactggtaacatggatgaagaacatagaacctggttttgcgcacgttatgcctggtattgccaacagatgatgcaaaccagagaacttgaattagaacactgatattacgggccgtctggcccgtttttgtgttgctttattctgctttatcaataggcgggatagccggaggagattgaagatctgctaccgaattattgcgcgcttccagttcactgatgcgctgctccagtaatgccagtttctcacgagtccgtaacaggacttgcgtctgtacgtcgaattcttcgcggctcaccagatcgagacgcgtcagttgcgcttgtagggtttggcggatttttttctccacatcttccccgaactccctgattcctttaggcattgattcgtgaacctggcgagcgatttgctcaatttttttcgggtcaatcattgtagtttccctgtactgataggtgttgagtgccattgtagtgcgataagggtaagtcataaaccagaattatgtgaagctatgcgttgctggcgctaatcattagcgttatagtgaatccgcttattctcagggcggggcgaaattccccaccggcggtaaatcaactcagttgaaagcccgcgagcgctttgggtgcgaactcaaaggacagcagatccggtgtaattccggggccgacggttagagtccggatgggagagagtaacgattctgtcgggcatggacccgctcacgttattttggctatatgccgccactcctaagactgccctgattctggtaaccataattttagtgaggtttttttaccatgaatcagacgctactttcctcttttggtacgcctttcgaacgtgttgaaaatgcactggctgcgctgcgtgaaggacgcggtgtaatggtgcttgatgatgaagaccgtgaaaacgaaggcgatatgatcttcccggcagaaaccatgaccgttgagcagatggcgctgaccattcgccacggtagcggtattgtttgcctgtgcattactgaagatcgccgtaaacaacttgatctgccaatgatggtagaaaataacaccagcgcctatggcaccggttttaccgtgaccattgaagcggctgaaggtgtgactaccggtgtttctgccgctgaccgtattacgaccgttcgcgcagcgattgccgatgacgcaaaaccttctgatctgaatcgcccgggccacgttttcccacttcgcgctcaggctggtggtgtactgacgcgtggcggccatactgaagcgactattgatctgatgacgctggcaggctttaaaccggctggtgtgctgtgtgagctgactaatgacgatggcacgatggcgcgtgcaccagagtgcattgagtttgccaataaacacaatatggcgctcgtgactattgaagacctggtggcttatcgtcaggcacatgagcgtaaagccagctgaaaaccgctgcttaatttactgccttaatcaagaaaccgaagttgtagcaggcttcggtttttatttttccctgctatgcaagatgttaattccgcttctctttctatgagaaaatttcattaatatcaggcattctttttcattatgatcaaaatcatataattgttccgttattatgcgaccatatgaatatatccgaaaaaggatatgtgaaatttatgcgctaaatgtttagtattgttaaatattaagggtaaaaggatgtttatcgcctggtactggattgtattgattgctctggttgtggtgggttatttcctgcatttgaaacgttattgtcgggcgtttcgccaggacagagacgcactgcttgaagcgcggaacaaatacttaaacagtacgagagaagagacagccgaaaaggtagaataaggctttcgtgaagctggcagaagttgtccatgcgctggacaacttctgatgttgtttttaaccaattcccgccgtttgtagcagcactaaactgaatcccatcactgacattccacatagtacgccatagctggggttattattagggtcaatctctttggcgagcggcattaattcatcaaccgagagcgccaccataattcctgcaaccgccgccatgattgccgccatgaccaccggggaaatcatgctaccgaggattaaccacgccagcacaccaccaagaatttctgccagtccagaaatccccgcccacagaatcgcggtgcgtttagaccccgttgccgcgtaaaccgggcctgcaaccgccagaccttcaggaatattgtgtaacgcaacggccagtgcgatgccaaagcccagctccaggttgctgctcgcagtgacaaaggtggcaatcccttccgggaagttatgcagactgatgccgagagtgagcagaatggctgtgcgcttgatcgattttggcaacggctgcaccgatttttgcattaaatcctgcggatgcgcatgtggcaacatgcggtccaggccaaaatagccaagcagaccgaagataaacattccataacccaacacaggcgacattccttcagctgctagtgcggcaggaagcatttccattaatgagatgagcaacatgatccccgccgcaaatcctagcgaaaacgccagtaagcggttcgagggtttttgcccgagaacgccgagaaacgcgccaataaacgtggctgcccccgccagtatggtcagaatgagaggtactgacatcgacaactccttataaatcttcaccttcaggcagatcgtcaaaataactgatgatcatcatcattgttatccgggttcttactccgccgaacaagcgtattgtgaggatatcaaaatgacacctttagttaaggatatcatcatgtcttcaacacgtatgccagcattgtttttaggtcacggtagtccgatgaacgtgctggaagataatttgtatacccgcagctggcagaagttggggatgacattgccacgcccgcaagcgattgtggtggtttcggctcactggtttacccgtggaacaggagtgaccgcgatggagacgccgcccacgattcatgactttggtggcttcccgcaggcgctgtacgacacgcattatcctgctccgggttcgcctgcgctggcacagcatctggttgagctgttagcgccggtcccggtgacgctggataaagaagcctggggctttgaccacggctcgtggggcgtgctgattaagatgtatccgcaagcggatatcccgatggtgcagttgagtatcgacagtagcaaacctgccgcctggcatttcgaaatggggcgcaaactggcagcgctgcgggatgaaggaataatgttggtcgccagcggtaacgtggtgcataacctgcgtacggtgaagtggcacggtgatagttcaccgtatccgtgggcgatgtcgtttaatgagtatgtgaaagcgaatctgacgtggcaagggccggtagagcagcatcctctggtgaattatctcgaccatgaaggtggcgcgttatcgaatccaacgccagagcactatctgccgttgttgtatgtcttaggtgcgtgggatgggcaggagccaattaccattccggtcgatggtatagaaatgggcagtttaagtatgctgtcggtgcagataggttaataaaagaacccgaagccagaacgactggcttcgggtgttgctgagttagcctctgatgattttaagcgcccatgcgccactcataatgaccagcagcaccagacacataccaaaagccagcatacaagcctgagccatattcataaaatgccatggtggtagcagataccagccttcagattgctgatacatttccacaaaccactgttgcgtgctgctcagtgtgacgccatcaggaacgattggtgcgtcatagccacaatccccggtaggcttgaaccaatttggtgcccactgtgccagcggcaggttaaagggaaaagttggatcggtagagcaaccctgtacgccaaacagtgaatcgggatccggattatgtactgcatggtggatatcgttcagtttgagcgaaaacttcagtcccaaaatgctgccgtaaaatgccatcacgcagccaattagctttaggatgatgttctttgggttgatcgctgcaaccaatcctccaataaccatcacaaacatggcgtagcgaatgtatacacattgctcacagggtgccatgtagagatagatctggaagaaagagtgcgccaggataattaacgcgcccatcgcaatggccattaacaaccacaaaaaacgttgttcttgccatcttaccagcgtgtccaccggtgaagtgcgaaggtctttccacattcccttaatacccatagcctgtttccctgttatttgcttgctaactcgcggataaggtctgccattgagtcaatagatttaatactcttggtgtagatcaggtatttaccattgacgacatacgccggaacgccctggatttttgcaacttcataagaggctttccatttttccagcgtttcctgaactgcaggctctttcagcgcggcttcaaaatcggcctgactcatacctgcggcgtccagtccggttttgataaaggcagccggatctttaccatcagaccagcgttcttttttgtcatgataagccgcgtaataagcaaacttggctttcttaaactgagagttagcatcaaataatgaaatacctgctgctttatctttattgatcaagaccgcaaagacttcgcttgcttgtttgccgtattcaccttttgtttccagatggaatggagtaaaagcaacgatatctttcactttttccgataccggaccggtaaccgctttgtcgtacttgtaacagaacgggcaggcgtagctaaataccttaatcagcgttttgtcggcattcggaataggtttttccagaaccatgtaatccgtgccttcggtaaatgcagaagcggtaaatgaaacagccaaagctgcggtaagcagtatggttttaaatagtgatgagatccctaatttcgacatttttattcccttcttaattatttgaacatctgttgtggacggactaacagtgcacgatagtgagtctgattgggtttatctgacagcacgtcgatttccactttcacttctttggttttgtaatcgatttcgttcaacttaccgacggttggctgcccgacatcgaacaaatgaatagaaccaccgaagccaaacatggtgttacggtcggcttgatattcaatgatggaggtaatcgggctatagaaatcgtagccacgttctttaccgtattcccacacttgctgaacggtgcctttcttctcatcaatcttatattccacaaagcgggagtatttcatggttggtaaggcaggttgttccagatgacgcccatcgccattatcaaaaatggtgagcgttcctttgctggaaatccaggcggtatgctgggtgtaggtaaagtcgaagtctgagttttcgcacaggccattttcgttacaggtaattggcttaccgttagcatcaaccggtttcagcagcttgctggccagcggtttttcccaacctttagagggcgcaaggatccatttcacttgcttatcacgaccaattttcacaacaccctggtggcgagaggagaggatgattgagtcatcttttgcgtcataggcgattgagttaacgtgcgcccagttacgacctggccctacacccagcgcgtcgccgaacggtgtatccggttccagttttgcctgttgtcctgcatgggcaaggtcaacgttaacgcaaactgcacctgcatccagcgcgccgagcagtgcatcgcgtttcggatcgaggatcttggtcagatcccatacatcgacaacgcgaccagatttatcgacttcgaggatatggtcacgaatggtggtgacgtgtacgccgtcatcgcgacggtaattgctcttacctacgcgcaacaatactgtgccattaggcgtctcaatggactcatgagtggcgtcagcaaatccgcgcggtagtttgtgatcttcgagcacctgccccatcatgtcgaactcgtaccagtgctgaccttgtacagcggtaaaggtgccgcgtggtgtttcgcggatacccatcagataaccacgcttgttgatatcgcggtcacgaccatcgtagaaagtgtcttgatccagccaccagcggtattcaccttcggtatcgacaatgaaagtaaagggcgcgatatcaaaaggtagtgcgccggttgccggacccgcatcaaggataccggcatttttatctttctcaccatgccagtggagatcggaaccttgggcggtaaaggtgtgggtattaaccagatagaggcgatcttcaaaacccggtgcgactttaataactttggtctgttgtaaatcggagatagagcggttatccatgtaattattgacgatggccgaagtgtgcaccacataatcatctttcatgaccttgccgttttctttccactcaacggtcactttgttagcaaatttctgataaagaccaaaaatcggtacaccatcataagtttttagtgattcctgacccacgggatagctgatttctacgcctttttcgcccttcccatggacggtaactttgacatcagaaatgacatggctatctaagtcaaccaaagcggtcagtggtgcattgccgtagggatcgacaatgactgcacccagttgcccggcaggtggtgcgggtttaaaacctgctgccatcacccccggtgctgacaaacccagagttatcgccacagctccggctaccagagtttttctatatttatcaaacatggatatatctccttatataacgcaaatatataataatgatgaatatcgactgttgaggtggtgctaataaatttgttttgtgaattaaaatgtattaataataatcgttatgaatattttttactggttttagaatttttgtatttctctgtaacaaatattttcttttggtcgatactaggtgggcaatatatcaataacaatattcaatattgtgtagtgtgatcccagcgacattgttttttaattattaaatctatttttgatgcggtgttggatataaataaactcataaaacaataggttaccaagtgattttattgattaatttaattacagtatcgcttacatatgacgatttaatattaaattaggaattaatgttaaataaaagtgatggatgtgattgattatatatagatgggggtgatgatttgcgaagtataataaattgccccggtaaacggggcaatattgaacagtattactcaacaaaaatatgcggataaaaccgagacatatcctgggtgatcaatgcacggtcttcacgaatgccaattccggcaggttgatcgttaaccagccagctaccaatcagcatatagctgtcgccgaatttcggtaacgggtggaattgctgaacaatcatcccttcttcgccatacggaccttccgctgcttcaatggttttgccgttctcaatgatcgacacgtttgcgccttcacgggagaagatcggtttaaccacatatttttccatttgcggatgatcatcttccgcaaaataagcgggcagcaggttcgggtgattcgggaacatctcccacaacagcggtagaagcgctttgttggagataatgctcttccacgccggttccagccagcgtacgcctgcatcctccagcttggtggagaacatctcacgcagcataaattcccacggatacagcttgaacaggttagaaatcacctgatcttgtaaatccgtgaactgacctttttcgcctaaaccgatatcgtcgatgtagaggaattcagtagcgatttcagcttctgtcgcgcagtcctgcaaatactgaatggttccgcgatcttccaccgtgtcgcgacagcaggtgagatgcagcaactggaagccatactgttcacgcaactcgacaaagcgatcgattagcttttcttgcagactgttaaactggtcgctgccttccggcaggttaccggcgttaagctgatcttccagccagatccactgaaagaatgcggcttcatacagtgacgttggcgtatcggcgttattttccagaagtttaggttcgccagtaccatcccacgccagatcaagacgcgaataaagcgatggctggtgagtcagccatgactggcgcacaaaactccaggtgtgttttggaatgcggaatttggtcatcagctcatcgctggcgatcactttttcaaccactttcaggcacatctggtgcagttcggcggtgacttcttccagcttttcaacctgggcgagggtcaacttgtagtaagcatcttcacaccagtacggttcgccgtacatggtgtgaaaattgaaaccgtattcgtgggctttttcgcgccagtccgggcgctcggtaatactgactctttccatcggtatcagccacccattgaacgagaagaggtgccggttgcgctacgctgcatagtgctttgtttggcaacagattcaccaaaaccgccacgagtaacggtggtggtggtcgccggttttggtgccattgccgtcttcggtacggtcatggtgcggcctggctgcgctgcgccatagtttttacccgtcgcgtcggtatatttaccgtaagccgggctggctgggtttttcgaggagaacagcggctgctgtgcaaatcccgcgccgccgcccatcagacgccccatcatgtaaccggccatcagcggcatccagaaacttccgctggattgctgggcctgcgcctggttttctggtgccataccagcctgggctggtgcctgctggcactgaccttcaccaaattcagcaacacagtcttcacgggtggcgtatttcggcgcagtacgttcggcttctttcagcgcattgttgtacgcggtggtacattcggcgcttttgcctgggtttgcagctgaacagtcgtcagcattttgatagagagacactgtttcatcactcttttcacagccagccagcataaaaacagtggcaaccgcgagagcgactggtgtcagatggcgtgcgctccagtttttgcggaacgatgcgtggcgtatggattttgtccgtttcatttttgtcttccgggaccagtggtaaatacccatcagaatagaggatggctggtcgaaattgaagcgagaagggggaagaatgcggcagataacccgtatctttacgttgccttacgtttagacggggccgaagccccgtcgtcgtcatcagttacggaaagggttatgaccgttactggtggtagtgcgtgcggatgtttgctgaacgacgggtgccgggctatcaggcgcataaccatcagcaatagcattctgttccggcgtttgcggggcaacgttttccggattagtggaaaccggtttgctcagcgcattgttcagtgccagcagatcctgctcgttcaacgtacccagagctgacttaatattcagctgattaatcaggtagttataacgcgcattcgccagctcttgcttggcgttgtacaacgtggtggtcgcatccaacacatcaacaatggtacgcgtaccgaccgagtagcccgcctccatcgcgtctaatgagctttgagcggaaactacggcttgtttgtaggcgttaatgctactgatagaagcattaatgttgttgaaggaggaacgtacggtttgtacgacgctacgatgcgcgctttccagttgctcgctggcaccaacaaagttgtactgggcctgtttcacctgcgagttaaccattccgccctgataaatcggcagcgagaagctcaggccaactttgttctggcccatattgctatcgtcatactgggtaccagcggcacctcgggttttcgaaccgctatatgaggtgtcagaaatcccggtagaagccgttaaatccagagtcggtaagtgaccatcctgcgcctggcgaatttgctcgcgtgccaggtcctggctcaagcgcgcctgtaacaacgacaggttgcgtttttcggcttctttcagcagcgtgttaaccggctgtggtttgtcggttttaaagttttcgacattcagcgccgccagttccggatagtagttaccggtgatctggcgcagctgctctaccgcgttatcaaggttattacgtgcggtcacttcgttcgccagcacggtatcgtactgtgcgcgggcgttctgcacgtcagtgatcgctaccaggcccacgttaaaacgttgggtggtttgatctaattgacggtagatcgcttctttttgcgcctgtgtataggaaagaacgtcaatagcattcaacacgttgaaataagcggtcgcggtgttgaggatcaaggtttgttgatcggtctgatacgtgacgtcctgaatcccagctgctttttcctgcagcgttaacgcacgccatttcgacatatcaaaaatggattgagttaactgcaaggacgcactggtcgcgttagagttgatgccgttcgcgtcgcggtagccgttgctataggtgtaatctgcacctaaacctagctgtggcagtaatggactgcgcgcttcattaattttttcaaaggcagcatcacgatcggcggcagacttacgcaattccgggttactaaggcgtgcttgctgataaacttgcatcaggttctcggcctggctcaacgaactgaacccagaaaggctcaggccgataagaatggggagcaatttcttcatttgcattccttgtggtgaagcagtatttagcgcgatcaaactgtaaaattattgcggattctagcagaagccgctaccgcaaaaggttggcgttacgtgccatagggcgttaatgtgcctcaatttaacacatgactgctcaaacggcagtcaaacgtcgctgaaattcacatttaattcactattagtgccaggacattaacaatgcttaagccagacaacctgcccgttacatttggcaaaaacgatgtagaaattattgcacgagaaacactttatcgcggctttttttcattagatctttatagatttcgtcatcgtctattcaacgggcaaatgagtcatgaggtacggcgggaaatttttgagcgcggtcacgccgcagtcttgctaccctttgacccagtgcgtgatgaagttgtgctgattgagcagattcggattgccgcgtacgacaccagcgaaaccccctggctactggagatggttgccgggatgattgaagagggtgaaagtgtggaagatgttgcccgtcgcgaagcgattgaagaggcgggactgatagtcaaacggaccaaaccggtgttaagtttcctggcaagcccggggggcaccagtgagcgttcgtcaattatggtgggcgaagtggacgccacgaccgcaagcggtattcacggtctggctgatgaaaacgaagatattcgcgttcatgtggtaagccgggaacaggcataccagtgggtagaagaggggaaaatcgacaacgcagcgtcggtcatcgctttgcaatggctgcagctgcatcatcaagcgttaaaaaatgagtgggcataaatgaagcgttacacacctgactttcctgaaatgatgcgcctgtgcgagatgaacttttcacaattgcgccgtttgttaccgcgcaatgacgcacccggcgaaactgtaagctatcaggtggcaaacgcacaatatcggctgacgattgtggaatcgacccgatacactaccctggtgacaatagaacagactgcgcccgcgatcagttactggagccttccgtcaatgacggtgcgtctgtatcatgacgcgatggtggctgaagtgtgttcaagccagcagatttttcgcttcaaagcgcggtatgattatcctaataaaaagttgcatcaacgcgacgaaaagcatcaaattaatcagtttttagcggactggttgcgatactgtttagcacatggagcgatggcgattccggtttattagcgtcgtgaaacctaaggacaccatttggaaagcctgttaacccttcctctggctggtgaggccagagtcaggattttacaaattaccgacactcacctgtttgcgcaaaagcacgaagccctgttgggggtaaacacctgggaaagctaccaggcggtgctggaggcgattcggccacaccagcacgaattcgacctgattgtcgcgacaggtgatttagcgcaggatcaatcctctgcggcctatcagcatttcgctgaaggcatcgcaagttttcgtgcgccctgcgtctggctgccgggcaaccacgatttccagcccgcgatgtacagcgcgttacaggatgcgggtatctccccggcgaagcgggtgtttattggtgagcaatggcaaatcctgttgctggatagccaggtgtttggcgtgccgcacggtgagctgagcgagtttcagcttgagtggctggaacgtaaactggccgatgcgccagaacgccatacgttgctgctgctacatcatcatccgctacctgcgggttgtagttggcttgatcaacacagcctgcgtaacgcgggcgaactggataccgtgctggcgaagtttccgcacgtcaaatacttgctgtgcggtcatattcatcaggagctggatctcgactggaacggtcgccgcctgctggcaacgccgtcgacctgtgtgcagtttaagccgcactgttccaactttacgctggacaccatcgcgcccggctggcgtactctcgagttacatgctgatggcacgctgaccaccgaggtgcatcgcctggcggacacacgtttccaacctgataccgcttcagaaggctactgatgtctacgcttctttatttacacggtttcaacagctcgccgcgctctgcaaaagcgagcttgttaaaaaactggttggcggaacatcaccctgacgtagagatgatcattccgcagttgccgccgtatccttccgatgcggcagaactgctggaatccattgtcctggaacatggcggcgattcgctgggtattgtcggttcgtcactggggggatattacgccacctggttgtcgcaatgttttatgctgcccgcagtggtggtaaacccggcggtacgcccgtttgaactgctgacggactatctcggtcagaacgagaacccctacaccgggcagcaatatgtgctagagtcacgccatatttacgatctcaaagtcatgcagattgacccgctggaagcgccggatttgatctggctgctgcaacagacgggagatgaagtgctggattaccgccaggcggtggcgtactacgcttcctgccgccagactgtcatagaaggcggcaaccacgcattcacgggcttcgaagattatttcaacccgatcgtcgattttcttggtctgcaccatctctgacgatcaactcgaattgctaacttaaaccatgacgcaaacttataacgctgatgccattgaggtactcaccgggcttgagccggttcgccgccgtccggggatgtataccgataccactcgccctaaccatttggggcaagaagttattgataacagtgtcgatgaagcactggcgggtcacgcaaaacgcgtggatgtaatcttacatgctgaccagtcgttagaagtgattgacgatgggcgcgggatgccggtggatattcacccggaagagggtgtaccggcggttgaactgattctttgccgtctgcatgcaggcggtaaattctctaacaaaaactaccagttctctggcggcctgcatggcgtggggatttcggtagttaacgccctgtcgaagcgcgtagaagttaacgtacgccgcgatggtcaggtttataacatcgcctttgaaaatggcgaaaaggtgcaggatttacaggttgtcggcacttgcggtaaacgcaatactggtaccagtgtgcacttctggccggatgaaaccttctttgacagcccgcgattttctgtttcacgcctgacgcatgtgctgaaagccaaagcggtattgtgccctggcgttgagatcacttttaaagatgagatcaacaataccgaacaacgctggtgctatcaggacggtctgaatgattacctggcggaagcggtaaatggtctgccgacgctgccggaaaaaccgtttatcggtaatttcgctggtgatactgaagctgtggactgggcgctactgtggctgccggaaggcggtgaactgctgaccgaaagctacgtcaaccttatcccaacgatgcagggcggtacccatgttaatggtctgcgtcagggcctgttggacgcgatgcgtgagttctgtgaataccgcaatattctgccgcgcggtgtaaagctgtcggcggaagatatctgggatcgctgcgcctatgtgctgtcagtaaaaatgcaggatccgcagtttgccgggcagacgaaagagcgtctctcttcgcgtcaatgcgcggcattcgtttctggcgtggtgaaagatgcctttatcctgtggctgaaccagaacgttcaggcggctgaactgctggcggagatggcgatttccagcgcccagcgccgtatgcgtgcggccaaaaaagtggtgcgtaaaaagctgaccagcggcccggcgttgcctggcaaactggctgattgtaccgcgcaggaccttaaccgtaccgagctgttccttgtggaaggtgactccgcaggcggatctgccaagcaggcgcgcgatcgcgaatatcaggcgatcatgccactgaaaggtaagatccttaacacctgggaagtctcttccgacgaagtgctggcttcgcaggaagtgcacgatatttcggtagcgatcggtatcgatcctgacagcgacgatctgagccagcttcgttatggcaaaatctgtatcctcgcggatgcggactctgatggtctgcacattgccacgctgctctgcgctttgttcgtaaaacatttccgcgcgttggtgaaacacggtcacgtttacgtcgcactgccaccgctctaccgtattgatctcgggaaagaggtttattacgcgctgacggaagaagagaaagagggcgtacttgagcaattaaaacgcaagaaaggcaagccgaacgtccagcgttttaaaggtctgggggaaatgaacccgatgcaattgcgcgaaaccacgcttgatccgaacactcgccgtctggtgcagttgactatcgatgatgaagacgatcagcgtactgacgcgatgatggatatgctgctggcgaagaaacgctcggaagatcgccgcaactggttgcaagagaaaggcgacatggcggagattgaggtttaaaggaaagaacattgcccggtcaggatggccgggcaaacaaggcaggattaaatccctggctgcagaatacggatattcatctccagcacgtcaccttttacggcttcgctatacgccttcatgtgcggggtttgcagatgcgcttcaagatgcgcgatgctttcccactgctcaatcatcacgatagaatccggtgccatagactggaaactcacgccagctgcgcaatccaccattggcgcatagccgtggcaaccttcttctttcagtacggttggaacgattttagcaaactgatccaataccgcctgacggtgatgttgaccaggacgagtacggatttctgcgattacggtaagcatggttaactccttctaaagcctgagctctagttaaccaaaaatttccacaagatgcttgcgatattcttcagtatagcggggaacatcaggcatttttatcacgtcattagcgataaatgtcggcagcggttccataccgaggaattggtttgctttatggaacggcagatacacaccgtcaacgccaacgccgtggaagaactgatctttttcggtgaaggcttccattggtgcgttccaggtcagagaaagcatatattttttgccctgtaccaggccgccggaaccgtattttttcgacggatctttgcgggtacgaccatcgctggcatacagcgtcccgtgaccttcggtgaatacatcatcaatgtattttttcactgtccacggcgcgcccatccaccagcctggcatctgccagatcaccacatcagcccagagaaagttttgtacttccgctttgacatcgtagtcgctgtcggcgcgaacgatgcggacatcatgcccaaggtcgcgcagtgtgccatccgcgacttcggtcagggtgtcgttcagttgaccattggagtgggcgaattttttcgcgccgttgataatcaggatgttgctcattttttaacctcaaggtgagacgtttgccgactatagtacgtcacagagcggtacggtgaaattagcaaaatgtgcaaagtcttttgcgaatttagcaaaagtctgatcttactctgactcaccgatgcaggataaatattttctgaaaatgacaatactgatagccattcctcataattcttacaattcttactcgcaccggaataatttacacgtttggttcggtttttttggggattgaaaatatggctttgaataagtaaaagatgaaagtatcaacgtgtcatgttgataattataaatggatttttatgagcgtactgatatatgttaaagcagaaaattaaaacaatatttgaagcattgctatatataatgcttacttattggttaatagattctttttttgctttcaataagtatgactggatgcttgagtcgggaggaaatatttgcagtataccttccgtttcaggcgaagatcgtatattgcaagcaatgattgcagcattttttcttcttacgccacttattattcttatcttaagaaaactctttatgcgggaaatgttcgagttttgggtatatgtattctcgctcggtatttgtctggtttgtggttggtggcttttttggggacggtttatattttgctattagtaaaatctatgagagtcgttttaacggctctcatagacagagaagttaccagcttaccttcgcctcaaatccaccttgttccgcattcccaaattcaacattcatgccatgcaatttggcgattcgctggacaatcgatagcccaagcccgctgccggtagcggtttgtccgggtgggcgatagaagcgttcgccaattcgcgccagtgcctctggtgtcacaccggggccgttatccctcacgatgaaattatcagcattcagcgtgacgtctaccacgctgccctgtggactgtagcgcacggcgttatccagcaaatttcgcaccaacaaacttagcaatagcggttgcccggtgcgtttgatgctgtgggcattgagtgtcagtcgcacgtcaattttcgcctgctgcgccgtgtggtaaatatccatcaccgacgattgcaggagatcttcaagcgggatctccgcgacgtcctgaaggttatccagtgagtccagccgcgatagcgtgagcagttgatcaaccagacgagtagcgcgatcgatcccggaatgtaattggagcagtgcttttttccgcgcctgcggatcatcgtcagagagctgcgcaacttcggtttgcactttcagcgccgttaacgggctacgaagttcgtgagctgcgtcggaggtaaagcgtcgttcacgaaccatcatcgcatgtgtgcgggcgaacagttgatttagcgactcaaccagtggccgcacttcgctgggtacgccagtcgcgtttagtggtttttccgagtcagggtcacgcatacgtagtgccagcgccagtttgttcagcggcgcgagttcacgacccagtagtaccatcatgatgattaacataatcggcagtgcgaccagccacgggatcaattgcccggcaacaatcgccagcgccatgtcttcacggtattcccattcctggccaacaacgatgcgatatttgccatcaggtgaggtcatccagacaaaacgccaaggatcgtcttcaccgaccagttgcccgtcagcaaaaccttcccgttgatagctatagggaatatcttctccgttatcgccatcattaaggaccattctgccgtcgtgggtaaagatggcaaaggtcagcgcatcgtcatcaacatgaccgtgttttaatctatttggcgtctgtgccatgcgatccgccgcgttgatttcgttgagatcgagcgtacttaaccgcttggcaaacagcatcagttgggtgtcgaacaattcatcgacgttatccgttgtttgtttccaggcgacaaagctggaaagcagccaggtcaccgaggccagaattaaaaagattagcgtcagcctgacgcgcagactaagacgttgggtaaatttcatttctcacctaatgtgtaaccaataccatgcacggtacgaataaaatcactaccgagtttgcgtcgcagatgatgcacatgcacttcaacggcattactggtgacctcttcgtcccaggtatacagtttctcttcaatcagtttgcgcggcagtacccgaccagcgttacgcatcagtaattccagcagggcaaattcttttggtttcagtgttaagggttcgccagccagcgtggcgatacgtttgccggggtcgagcatgacgttaccgtggcgcagctcgttgctggcctggccgttggttcggcgcatcagagcttccagcctggcggcgacttctatcaacgcaaaaggtttacacagataatcgtcagctcccagacgcagcccttctacacgttccgccagcgcatcgcgcgcggtcaggatcagtaccggctcacgctgacctttttctcgccattcgcgcaaaatatcgcgaccatccatgcctggtaaggttaaatccaggatcaccgcatcataaggtgcgctataaagcgcctcttttccctgacgaccttgtgtaaaccagtcgacgctaaaacccattttactaaggcccgttttgatgccgtcgccaatcagcatgtcatcttctatcagtaaaattcgcattttttcatccctgcgataaccgtatttgctgccagtaaaccgtgttgtaacgcgctctgtacagcactaaattttatttttttcccttaagaagttgttaaggactatcttgttaaatgctcggaaacagacattaaagggagtaataaacatgaaaaaattcgcagcagtaatcgcagtaatggccctgtgcagcgcaccggtgatggcagcagagcagggcggtttttctggcccatcggcaacgcaaagtcaggccggaggattccaggggccgaacggcagcgtaacgactgtagaaagcgcaaaatccctgcgtgacgacacctgggtaaccctgcgcggcaatatcgttgaacgcatctctgacgatctctacgtgttcaaagatgccagcggtactatcaatgttgatatcgaccacaaacgctggaacggcgtgacggtgacgccgaaagatacggttgagattcagggtgaagtcgataaagactggaattctgttgaaattgacgtcaaacagatccgcaaagtaaatccgtaattgttaccgctcccgggacgcgttcccgggaataatttcgcagggaggcaaaatgacaaacctgacactggatgtaaacattatcgatttcccatcaatacctgtggcgatgttgccgcaccgctgtagccctgaattgctcaactacagcgtggcgaaatttatcatgtggcgtaaagagacggggctttctcctgttaaccaaagccagacttttggcgtcgcctgggacgaccctgccaccaccgcaccggaagcgtttcgctttgatatctgcggcagcgttagcgaaccgattcccgataatcgttatggtgtgagcaatggtgaacttaccggtggacgttatgccgtggcccgccacgttggcgagctggacgatatttcacacacggtatggggcatcattcgccactggctgcctgcaagcggcgagaaaatgcgtaaagcaccgattctgtttcactacaccaatcttgccgaaggggtgacagagcagcgactggaaacggatgtttatgtgccgttggcgtgatgcctgactccagcttcccttataaattcctgcttcaaactggcgctactaatgcgccactttcttatatggtcaatcactttccttaaagaatacgttttgtgtggtcactatctccgtacatctaactaaccttttaggtgctttttcattgctgtaattaaccttttaggttataactaaagtaacagggaggcgggggttatggaaaaacgcacaccacatacacgtttgagtcaggttaaaaaacttgtcaatgccgggcaagttcgtacaacacgtagtgccctgttaaatgcagatgagttaggtttggattttgatggtatgtgtaatgttatcattggattatcagagagcgacttttataaaagcatgaccacctactctgatcatactatctggcaggatgtttacagacccaggcttgttacaggccaggtttatcttaaaattacggtaattcatgacgtactgatcgtctcgtttaaggagaagtaatatgaaatgtccggtttgccaccagggagaaatggtttctggcattaaagatattccatacaccttccgtggacgaaaaacagtattgaaaggtatccacggtttatattgtgtccattgcgaagagagcatcatgaataaagaagagtcagatgctttcatggcgcaagtaaaggcatttcgggcttcggtgaatgccgaaacagtggcacctgaatttatagtgaaggttcgaaaaaagctctctcttacccaaaaagaggcaagcgaaatttttgggggaggtgtaaatgcgttttcgcgttacgaaaaaggcaatgcccaacctcatccttccacaatcaaacttttacgtgttctggataagcatccagaactattgaatgaaatccgttaattaatggaaaagcgggggcaactcgcttttttctttaccggagtgtgagccaaatcactcgcgataagtttgagcgaacaatgccacaggcgtattgttgttgggcttataatttctccggtaaggaataccatgtatacgcgaaatttattatggctggtcagcctggtaagtgcggctcctctctacgctgctgacgttcccgccaacacaccgctcgccccgcaacaagtctttcgttacaacaatcatagcgacccaggtacgctcgacccgcaaaaggtggaggagaatactgccgcgcagattgtgctggatctgtttgaaggtctggtatggatggacggtgaaggccaggtgcagcccgctcaggctgaacgctgggagatactggacggcggcaagcgctatattttccatctgcgtagcggtttgcagtggtccgacggtcagcctctgacggcagaggattttgtcctcggctggcagcgcgcggttgacccgaaaacggcaagcccttttgctggctatctggcacaggcgcacattaacaatgccgcagctattgttgcgggtaaagcagatgttacatcgctgggtgtcaaagcgacggatgatcgtactcttgaagttacgcttgagcagccggttccttggttcacgacgatgctcgcctggccgacgctgttcccggttcctcatcatgtcatcgctaaacatggcgatagctggagtaagccagagaacatggtttacaacggtgcctttgtgcttgatcagtgggtagttaacgaaaagattactgcacgcaaaaatccaaagtaccgcgatgcgcaacatacagtattgcaacaggttgagtatctggcgctagataattcggtcaccggctataaccgctatcgcgcgggagaggtcgatctcacctgggttccggcgcagcaaattcccgccattgaaaaatcactgcctggcgagctacgaattattccgcgtctgaacagcgaatattacaacttcaaccttgagaaaccgccatttaacgatgtgcgagtgcgtcgggcgctatatcttacggttgatcgacagcttattgcgcaaaaggtactggggttgagaacgcccgcaaccacgctgacgccgccagaggtaaaaggctttagcgcgacgacgttcgatgaactgcaaaagccaatgagtgagcgcgtcgcgatggcaaaagccttgctgaaacaggcgggatacgacgcctctcatccgctacgctttgagctgttctacaacaagtacgatctgcatgaaaagaccgcgatagcgttgtcttccgaatggaaaaaatggctgggtgcacaggtgacgctgcgcacaatggagtggaaaacctatcttgatgcccgacgagccggtgatttcatgctgtctcggcagtcgtgggatgcgacgtacaatgatgcttccagcttcctgaacacgctcaaaagcgatagtgaagaaaacgtcggtcactggaaaaatgcgcagtatgacgccttactaaaccaggccacgcagatcactgatgcgacaaagcgtaatgcgttgtatcagcaggcagaagtgatcatcaaccaacaggcaccgctgattcctatctactatcagccgttaatcaaactgcttaaaccctacgttggcggttttccgctgcataatccccaggattatgtctacagcaaagagttgtatatcaaggcacattgatgcctttatcgccgtcggagcacgtccggcggcgctattcacgctgatctcctgtgactcgacgcggcagataatgtagtatctccggcaatattgcccctttgaaggctggcgaataagttgaggaatcagaattaatgagcgatatggcagagcgccttgcgctacatgaatttacggaaaacgcctacttaaactactccatgtacgtgatcatggaccgtgcgttgccgtttattggtgatggtctgaaacctgttcagcgccgcattgtgtatgcgatgtctgaactgggcctgaatgccagcgccaaatttaaaaaatcggcccgtaccgtcggtgacgtactgggtaaataccatccgcacggcgatagcgcctgttatgaagcgatggtcctgatggcgcaaccgttctcttaccgttatccgctggttgatggtcaggggaactggggcgcgccggacgatccgaaatcgttcgcggcaatgcgttacaccgaatcccggttgtcgaaatattccgagctgctattgagcgagctggggcaggggacggctgactgggtgccaaacttcgacggcactttgcaggagccgaaaatgctacctgcccgtctgccaaacattttgcttaacggcaccaccggtattgccgtcggcatggcgaccgatattccaccgcataacctgcgtgaagtggctcaggcggcaatcgcattaatcgaccagccgaaaaccacgctcgatcagctgctggatatcgtgcaggggccggattatccgactgaagcggaaattatcacttcgcgcgccgagatccgtaaaatctacgagaacggacgtggttcagtgcgtatgcgcgcggtgtggaagaaagaagatggcgcggtggttatcagcgcattgccgcatcaggtttcaggtgcgcgcgtactggagcaaattgctgcgcaaatgcgcaacaaaaagctgccgatggttgacgatctgcgcgatgaatctgaccacgagaacccgacccgcctggtgattgtgccgcgttccaaccgcgtggatatggatcaggtgatgaaccacctcttcgctaccaccgatctggaaaagagctatcgtattaaccttaatatgatcggtctggatggtcgtccggcggtgaaaaacctgctggaaatcctctccgaatggctggtgttccgccgcgataccgtgcgccgccgactgaactatcgtctggagaaagtcctcaagcgcctgcatatcctcgaaggtttgctggtggcgtttctcaatatcgacgaagtgattgagatcattcgtaatgaagatgaaccgaaaccggcgctgatgtcgcggtttggccttacggaaacccaggcggaagcgatcctcgaactgaaactgcgtcatcttgccaaactggaagagatgaagattcgcggtgagcagagtgaactggaaaaagagcgcgaccagttgcagggcattttggcttccgagcgtaaaatgaataacctgctgaagaaagaactgcaggcagacgcgcaagcctacggtgacgatcgtcgttcgccgttgcaggaacgcgaagaagcgaaagcgatgagcgagcacgacatgctgccgtctgaacctgtcaccattgtgctgtcgcagatgggctgggtacgcagcgctaaaggccatgatatcgacgcgccgggcctgaattataaagcgggtgatagcttcaaagcggcggtgaaaggtaagagcaaccaaccggtagtgtttgttgattccaccggtcgtagctatgccattgacccgattacgctgccgtcggcgcgtggtcagggcgagccgctcaccggcaaattaacgttgccgcctggggcgaccgttgaccatatgctgatggaaagcgacgatcagaaactgctgatggcttccgatgcgggttacggtttcgtctgcacctttaacgatctggtggcgcgtaaccgtgcaggtaaggctttgatcaccttaccggaaaatgcccatgttatgccgccggtggtgattgaagatgcttccgatatgctgctggcaatcactcaggcaggccgtatgttgatgttcccggtaagtgatctgccgcagctgtcgaagggcaaaggcaacaagattatcaacattccatcggcagaagccgcgcgtggagaagatggtctggcgcaattgtacgttctgccgccgcaaagcacgctgaccattcatgttgggaaacgcaaaattaaactgcgcccggaagagttacagaaagtcactggcgaacgtggacgccgcggtacgttgatgcgcggtttgcagcgtatcgatcgtgttgagatcgactctcctcgccgtgccagcagcggtgatagcgaagagtaatatgccggggagggcgctgtttcctcccgcttgcaaggaacgccggatgaaacgttaagtcgtcatccggcagcgtattcaacccccggaaacgataaaaattcccttgaaaccgttgtttattcatgcgttgcgattaacaatacgcttttccagagagcggcttttaacaatgccctaacctgatttcaggtgacgtacaatgccagtctctcagaccttcagagggtgttatgctatatatctttcgtcttattattaccgtgatttacagcatcttagtctgtgtattcggctccatttactgccttttcagcccgcgtaacccgaaacatgtggccacctttgggcatatgtttggccgtcttgcgccgctgtttggcctgaaagttgagtgccgtaaacctacagacgctgaaagctacggcaatgctatctatatcgctaaccaccagaacaactatgacatggtgacagcatcgaacatcgtgcaaccgccgacggtgacggtaggtaaaaagagcttgctgtggatccccttcttcgggcagttgtactggttaaccggcaacttattgatcgacagaaacaatcgcactaaagctcacggcaccattgcggaagtagtgaatcacttcaaaaaacgccgtatttccatctggatgttcccggaaggaacccgcagccgtggtcgcggcctgctaccgttcaagactggagcatttcacgcggcaattgcggcgggcgtcccgattattcccgtgtgcgtctctacaacttcgaataagattaatcttaatcgactgcacaacggtctggtgattgtcgaaatgctgccgccaattgacgtcagtcagtatggcaaagatcaggttcgtgagctggctgcccattgtcgttcgataatggaacaaaaaatcgccgagctcgataaagaagtcgcagaacgcgaagccgccggaaaagtttaagtcggcaatctgtatttttgcggggaacactttcctgcacggtattactttagccagttttacatggagcaaatatgtcactcagtcggcgtcagttcattcaggcatcggggattgcactttgtgcaggcgctgttcccctgaaggccagcgcagccgggcaacagcaaccgctacccgttccgccgctacttgaatctcgccgtgggcaaccgctgtttatgactgtacaacgtgcgcactggtcatttacgccagggacacgcgcgtcggtctggggaatcaatggtcgttacctggggccgactatccgcgtctggaagggcgacgatgttaagcttatttacagcaaccgcctgacagaaaatgtctcaatgacggtggccgggctacaggtaccaggcccgctgatgggcggtccggcacggatgatgtcgccaaacgctgactgggcacccgtactgcccattcgccagaacgcagctactctgtggtatcacgccaatactcccaaccgcacggctcagcaggtctataacggccttgccggaatgtggctggtggaagatgaagtcagcaagtcgctgcctatccccaaccattatggtgtggatgattttccggtcattatccaggataaacggctggataactttggtacgccagaatacaacgaaccgggaagcggcggctttgttggtgatacgctgctggttaacggtgtacaaagcccgtacgttgaagtctcgcgtggctgggtgcgcttgcgactgctgaacgcgtcgaactctcgtcgctatcaactacagatgaacgatggtcgcccgttacatgtgatttctggcgatcagggattcctgcctgctcctgtatcggtgaagcaactttcgctggcaccgggcgagcgccgcgagattctggtggatatgagcaacggcgatgaagtgtcgatcacctgtggcgaagcggcgagcattgttgatcgtattcgtggcttctttgagccatccagtattctggtttctaccctggtgctaacgctgcgcccaaccggccttctgccgctggtcacagacagtcttccgatgcgcttgctgccaactgaaatcatggctggttcgccaattcgcagtcgcgatatcagtctgggtgatgacccgggtattaatggacagctgtgggacgtcaaccgtattgatgtcaccgcgcagcaaggaacgtgggaacgctggacggtacgcgcggacgagccgcaagcgttccatattgaaggcgtaatgttccagatccgtaacgtgaatggcgcgatgccgttcccggaagacagaggctggaaagataccgtttgggttgacggacaagtggagctgcttgtttatttcggtcagccttcctgggcgcacttcccgttctacttcaacagtcagacgctggaaatggcggaccgtggctcgattgggcaactgttggtcaatccggtaccgtaatcttcatactcgcccgaggagggcgagtatggaatacctttcgatttctctttcgttccggcttataatccccggcctttgattatttttttatcatttctggaagcaaaatgagctctatctccctgatccaaccggatcgcgacctgttctcctggccgcagtactgggccgcctgttttggaccggcaccgtttttgccgatgtctcgtgaagagatggatcaacttggctgggatagctgcgacatcattttggttactggcgacgcgtatgtcgatcacccaagcttcgggatggcgatttgcggtcgtatgctggaagcgcagggctttcgcgtcgggatcatcgcccagccggactggagcagcaaagacgactttatgcgtctgggtaaaccgaatctgtttttcggtgttactgctggcaacatggattcgatgatcaaccgttataccgccgatcgccgtttacgtcatgacgatgcctacacgccggataacgtcgcgggtaagcgcccggatcgcgccacactggtttatacccagcgttgtaaagaggcgtggaaagatgtaccggtgatcctcggcggtattgaggctagtctgcgccgtaccgcgcattatgattactggtccgataccgtgcgccgttccgtgctggtggattcgaaagccgacatgctgatgtttggtaacggtgagcgtccgctggtggaagtggcgcatcgtctggcgatgggcgagccaattagtgaaatccgcgatgtgcgtaataccgcgattatcgtgaaagaggcgctgcctggctggagcggcgtggattccacccgtcttgatacccctggaaaaatcgacccaatcccgcatccgtatggtgaagatttgccgtgcgcggataacaaaccggtggcaccgaaaaagcaggaagccaaagccgtaaccgtgcagccaccgcgcccgaaaccgtgggaaaaaacctacgtgttgctgccttctttcgagaaagtgaagggcgataaagtgctgtacgcccatgcttcgcgtattctgcaccacgaaaccaacccaggctgtgcccgcgcattgatgcaaaaacacggcgaccgctatgtgtggatcaacccgcctgctattccgctttctaccgaagagatggacagcgtttttgcgctgccatacaagcgcgtgccacatccggcctatggcaatgcccgtattccggcttacgaaatgatccgtttttcggtcaacattatgcgtggctgctttggcggctgctctttctgttctatcaccgagcacgaagggcgcattattcagagccgttccgaagattcgatcattaatgagatcgaagcgatccgcgacaccgttccaggttttacgggcgtgatttccgatcttggtgggccaactgccaacatgtatatgttgcgctgcaaatcgccacgcgctgaacaaacttgtcgccgtttgtcgtgcgtttatccggatatttgtccgcacatggacacgaaccacgaaccaacgatcaacctctatcgccgtgcgcgtgatctgaaaggcattaaaaagatcctgattgcctctggtgtgcgctatgacatagccgtagaagatccgcgctatatcaaagaactggcgacccatcacgtcggcggttatctgaagattgccccggaacataccgaagaagggccgttatcgaagatgatgaagccgggcatgggcagctatgaccgctttaaagagctgttcgatacttactcaaaacaggcaggtaaagagcagtatctgatcccctatttcatctccgcgcaccccggtacgcgtgatgaagatatggtgaatctggcgctgtggctgaaaaagcaccgcttccgcctcgaccaggtgcagaacttctatccgtcgccgctggcgaactcaaccaccatgtattacaccgggaaaaacccgctggcgaagattggttataagagcgaagacgtcttcgtaccgaagggcgacaaacagcgtcgtttgcataaagcgttgttgcgttaccacgatccggcaaactggccgttaatccgccaggcgctggaagcgatgggcaaaaagcatctgattggcagccgtcgcgattgcttagtgcctgcgccaaccattgaagagatgcgtgaagctcgtcgccagaaccgcaatacccgtccggcgttgacgaaacatacgccgatggcgacccagcgtcagacgcctgctacggcaaaaaaagcgtcgtctacgcaatctcgtccggtgaatgctggtgcgaagaaacggcctaaagcggcggttggacgttaaaaaatatccccggcaactgacacgctaccggggatttttttatcattctgcgtacatacgcaagcagcgcaggcaatcaaaatagtcctgagcatcaagacgcgtattggctctgttagcttcggatttggcagcatagatttgtgggcgtagtgctttcatatcctgctcaagccgggcgattttggcatttaatgtttgcacattgctcgccagctgattgaccttttgctcattgacgcagccactgagcaagcaggttgccagaacaacagctcccacggtgaaaatcgttttcatatagtgttcccttttatttattgttccggctaattgttatttaattcagctcattgctttaatctggcggcagtttttgcctcaatctgcttaagtaggctgccgctgttcgggcggataaaatcagcgatttcccacttgccttcgcgccgctgtaaaaccagttcttgctcttcgttgttgccattggtcagcgtaaaacgaacatgaatgcgggcggaatcggcggttttctccaggactcgaatttcatcaacgcgtgaaaatagcgactcttcgccaaaacagatcggattgtcgtaaataaattgccgttctatttgcatatcttcatcgggattattggccgtcttgaaggtggttttatagaaggcattaaccgcctggcggtaagagtcggaaaccacccacgtccacggccagctataatcagcaatatgttcaaagagttcggcaacaaaggcttccggctgttctttttgcaacgaagctaaagcggccagcgttttttcattctcgctattaactgcttgtaagacgctgccatgattgctgacaatatcgtcaatgacccaacgaccattttccgccaccattttcagtgtctgcgtggtcttttctttatcatctttaaagatacgaaagcgcacaacggcatcggcatgatcggcgtcagtttgggttatcgcgacgctttctagcaccagatcgccaaaatcctgacaatcacaaaccggatcataatccagccagccaatattgcccggcagcgtaagattgtcgttcagggtaagcgcctgttgaatacgcgcagaagttatcgcccgctctccggtttcaccaaaataagaggcagtggcatctgatttatagttctgataaatatgccggactgtttgttctacggtctgtgaggggggctgtgcgtgtacggtaaaacttgccagggctgctaaaaacagaagtattattttcatctgtttttcacctctccgttgcgtttatcccggatatagatgagttgttcttttaagagcttccggctctgcatgatgatgtccttatatttggcattcctgaacaaggaagagtaacaacgggcgggacgcgaggggaataaatgatttctgaaaagtccggtagcggaacattaccgccaccgggagaatttgcatgttagccgccgaactggtcaggatcgggaccgagacgcttgccctgatcgagttttgcaatttcgccgagttcgtctttgtcgagacggaaatcccagacatcaaagttttcggcaatacgtgaaggtgtgaccgatttcgggatcaccaccaggccgctatccagatgccagcggataacaatctgcgccggggttttgccgtatttatctgccagatcgcgaatgactttctgatcgaaaacgcctttccctccttgcgctaatgggctccaggattcggtctggattttgtgtgtcgcgttccaggcgtgtagctggcgttgttgcatcagcggatgaagttcgatctggtttatcacaggcgtcacgccagtttcatcaatcaggcgttgcaggtgatggatctggaagttgcacacgccgatgcttttgattaatccctctttttgcaattcgatcatgcctttccatgcttcgacataatggtcgatagcgggaacgggccagtgcattaagtagaggtcgatataatcaagctggagttttttcaggctgtcgagcagggcttcgcgggggcgcttgtggtcgtcgttccacagcttagtggtgatgaacagttcttctctgttgactgaggcatttttcagggctttgccgacaccttcttcgttcttgtaggccgcggcggtatcaatcgagcgataacccacttctaacgctttttgaatggcggtgattacttcctcattacttgcttgccagacgcccagtcccagctggggcatgacattgccatcctgtagcttaataacggttggattagccatacgttcctcctttatatgaactcaccggagcaggctccggtgaggtgttgtgaacttaagtctggacgaaatgcccgaaaacgaaagtttgaggcgtaaaaagcttagcgggcggcttcgtatatacggcggctgacatccaacgtaatgtcatgattttcgcccagttgggtcatgccgtgctcttccagttttttcagcaaagccgggatggagctgccgtccagaccgtagtcggagaggtgggtcggcacgcctaattgctcaaagaaattgcgggttgcggcaatcgcggcgtcaatacgctcatcatcggaaccttcagtgatgttccagacgcgttcagcatattgcagcagcttagcgcgcttggtatcgcgtttttcattccacagtgcaggcaggacgatagccagtgtttgcgcgtgatccagaccgtgcatcgcagtcagttcgtggcccagcatatgcgttgcccagtcctgcggtacgccagcgccaatcaaaccgttcagcgcctgagtcgccgcccacatgacgttggcgcgcacatcgtagttttctggctctttcagggctttcggaccatcttcgattagcgtcagcaaaatgccttctgcgaaacggtcctgaattttggcatcaaccggtttggtaacatactgttccacggtgtgtacaaaggcgtccactacgccgttagccacctgacgcggcggcagggtgtaggtataaaccggatcgagcacggcaaataccggctgaacatgggcagaatggaacgcctgcttgtcgcctgtggttttacgggagatcaccgcgcctgcgttggattctgaaccggttgctggcagcgtcagcacacagcccatcgggatggcgcttttaatctctttaccgcccgtttgcagaatgtgccacggatcgatattttccggatagttagccgctgcggcgataaatttggtgccgtccagtacagaaccgccgccaaccgccagcaggaaagtcactttctgttcgcgaaccagtttcacggcgttcatcagcgtttcataagccgggtttggctcaataccgccaaattccagcacgtccatgcctttcagggcatccagaacttgatcgagaacgccggtttttttcacgctgccgccgccgtaggtaatcaatacgcgagcatcgtgaggaatttgttcgcgtaaaccagcgattgcgcctttaccaaacagaatgcgggttggggtgtgcagattaaagttgttcattacttgctccctttgctgggccaatatgagggcagagaacgatctgcctgatgtttttcattgtgatcgccagcgccctggctctcaatgctcatttctgccaatgtcttgcctatttctccagagtgctggagaaatgctacaaaattgcgcacaatcaaattgccgcattattcctaagaaattacgcgatatgaaacgtgaagagatttgccgcttgctggcggataaagttaataaactgaaaaataaagaaaatagtttgtcagaactgttgcccgatgtgcgtttgttgtatggcgagacgcctttcgcacgtacaccggtgatgtacgagcctggcatcataattctcttttccgggcataaaatcggttatatcaatgaacgcgtgtttcgttatgatgccaatgaatacctgctgctgacggtgccgttgccgtttgagtgcgaaacctatgccacgtcagaggtgccgctggcagggttgcgtctcaatgtcgatattttgcagttacaggaactgttgatggacattggcgaagatgagcatttccagccgtcgatggcagccagcgggattaactccgccacgttatcagaagagattttatgcgcggcggagcggttactcgacgtgatggagcgaccactggatgcgcgtattctcggcaaacagatcatccgcgaaattctgtactacgtgctgaccggaccttgcggcggcgcgttactggcgctggtcagtcgccagactcacttcagtctgattagccgcgtgctgaaacggattgagaataaatacaccgaaaacctgagcgtcgagcaactggcggcagaagccaacatgagcgtatcggcgttccaccataattttaagtctgtcaccagtacctcgccgttgcagtatttgaagaattaccgtctgcataaggcgcggatgatgatcatccatgacggcatgaaggccagcgcagcagcgatgcgcgtcggctatgaaagcgcatcgcaatttagccgtgagtttaaacgttacttcggtgtgacgccgggggaagatgcggcaagaatgcgggcgatgcaggggaattaaatacgttcccggtacagcaaccgggaacggggaaaatcgtcaggcgttacagtatttttttttaatcaccacaaacagcgtgcctaacaagccagcggttaacaaggcaattggcaggatcatcaggaacgtcattacctgatcttcatggcgtttaacgaacggaatcatacttaaggcatagccaaaactggttaccacgctgacccacagcaatccacttaaccagttgaaaaactggaagcggcggtttggcagaccggaaattcccgccatggttggcagcagcgtacggacaaatgcaagaaaacgtccagccagcagcgccagcagaccgtggcggtcaaacatgcaggtggcgcgctggtgatatttagcaggaagctgtgccagccagcctttcaccgttttggtattccctaaccagcgcccctgaatataacttagccagcagcccagacttgctgcggcggtcagaatcgcaatcgtaggcagaaaatccataaccccctgggcaatcaatgcgcctgccagtatcaacaagctgtcgcctggcaaaaatgaggcgggcagcaggccgttttctaaaaacagcgtggcaaacatgacaaagtaaacaacgctaacaatatgaggatccgccagcgcggcaaagtcgtgttgccagagcgcagcgatgatatcttgaataacagccatggactttcctgtggaacagcgtttaagcctttatctgcctattgtactcctgaatcgtccgggacgccttgatcccggacgcaacaatttaagacttttcacaataaaatgtctgcaaaattgtccaaaagtggcaatgttatacaattcgcgcaaaaccggcgtccagatcggcaatcagatcgtcgacatcttccagaccaatatgcaggcgaatcaaggtcccgctaaaatcgatctcgccttgtgggcgaatggcggcgatatgttctggttgatttgccaggatcaacgattcatacccgccccacgagtaggccatgctgaataaactgaagttatccagatagttcgccagctcttcattattgagttttttcttaagcacaaaggaaaatagcccgctgctgcctgtaaagtctcgtttccagaattcgtgacctttactgccaggcagagcagggtggttaactcgcgcaacttgcggatgttctgccagccattcagccactttcagactgctttcatgatgttgacgcaaacgcacacctaatgtgcgcaggccacggctggttatataggcggtatcggcatcgaccatctggcccatcagataggcattttcccgtagctgctcccagcaacgggcattgcacacggcagtgccaatcatcgcatctgaatgcccaaccagatatttggtggcggcttgaatagaaacatcgatgccaaaatccagcgccttaaacagcacaccggctgcccaggtgttgtcgatcataatgatggcatccggcaccacactgcgtacggcggcaacaatcgccggaacgtcgtggacttccatggtgatggagcctggcgattccagaaacacgattttagtgtttggctgcagatgcttaacgatatcggcaccaatcagcggatcaaaccatgatgtcgttacgcccagtttgctgaggattttgctacagaaatcctgactcggttcataggcggtgttggtcatcaacacatgatcgccctgttcgataaaagcaagaatggaattagcaaccgctgccgccccgcagggaaatagcacgcagcctgcgccaccttccagttcacacatcgcttgttgtaaggagaaatgggttaacgttccgcgccgtccatagaacaactctccattggcgcgattacgtgtcgcgtgttttttggcttctacactgtcaaagaccagcgaagaagcgcgctgaatcacgctatttaccgcgccgagagtgtattttttgctgcgtcctgcattcaccagttgagtatcaagctttttgtccgccatgtcgggattcctgtttttatacgtctggatgtctaaactagcatgaatattcgcgggcgcatcctgaagaattggcataaagcagaaaattttcgcaaatggcgtgctggtgacttttttactgcgtaaacgcaaggaaaagaaagcaaaggtacggcagtatgcaaatagtaatgagaacgactatcaattcgacgtcgttttgatattattatgcgcagattttgtgacttgcgtcctggagatacacagtgggtaataatttaatgcagacggacctttccgtctggggtatgtatcagcacgccgatattgtcgttaagtgcgtgatgattgggcttattttggcctccgtagtcacctgggcaatcttcttcagtaagagcgtagagttcttcaatcagaagcgtcgccttaagcgcgagcagcaactgctggctgaagcgcgttccttaaaccaggccaacgatatcgccgctgattttggtagcaaaagcttaagcctgcatttgctcaatgaagcgcagaatgagctggaactgtcagaaggcagcgacgataacgaaggtattaaagaacgtaccagcttccgtctggagcgtcgggtcgccgcagtgggtcgtcaaatgggccgcggtaacggctatctggcaaccatcggcgcgatttctccgttcgttggtctgtttggtacggtctggggcatcatgaacagctttattggtatcgcgcaaacgcagaccactaacctggcagtcgttgcgccgggtatcgcagaagctctgttagcaacggcaatcggcctcgtggcagcgattcctgcggtcgttatctataacgtatttgcacgccagattggcggctttaaagcgatgctgggtgatgttgcagcgcaggtattgttgctgcaaagccgtgacctggatctggaagccagcgccgctgcgcatccggttcgtgtcgcacaaaaattacgcgcaggataatatccgatggcaatgcatcttaacgaaaacctcgacgataacggcgaaatgcatgatatcaacgtgacgccgtttatcgacgtgatgttggttctgctgattatctttatggtggcggcaccgttagcgacggtagatgtgaaggtgaacttgcctgcttctaccagcacgccgcagccgcgcccggaaaaaccggtttatctgtcggtgaaggcagacaactcgatgtttatcggtaacgatccggtcaccgatgaaacaatgattacggcgttgaatgcgttaaccgaaggcaagaaagacaccaccatcttcttccgagcggacaaaaccgtcgattacgagacgttgatgaaggtaatggatacgctgcatcaggcgggttacctgaagataggtctggtcggcgaagaaaccgccaaagcgaagtaaagtagaattgcctgatgcgctacgctcatcaggcctacaaaatctattgcaacatgttgaatcttcgtgcgtttgtaggccggataaggcgttcacgacgcatccggcattaggtgctcaatgcctgatgcgctacgcttatcaggcctacaaaatctattgcaacatgttgaatcttcatgcgtttgtaggcggataaggcgttttcgccacatcaggtaagagtgaattcacaatgatgcccggttgcttttcacaaccgggcatttttgtgcacagaaaacccccagctaggctgggggttccggaaagctttcagctttgtcataaactgcaccttcagatgtcagattatgtccaacatttggggtgcagttcagtcaagcgtcgcatcaggcattttggctcaaaagtatcaagccagtgctttagttatcttctcgtacagatcgccagagagattttccagccctttcaactgctccagcgccgcgcgcattttctcctgacgtttagcatcgtaacgtttcaggcgaatcagcggctcaatcaggcgtgaagccacctgcgggttacggctgttgaggtcggtaagcatttccaccaggaactggtaaccgctgccatcttcggcatggaacgctgccgggttgctgcccgcaaacgcaccaatcaacgaacgaatacggttcgggttgctcatggtaaatgagcgatgctgcaacaggccacgcaccgtctccagcacattcgccgccgggctggtggcttgcaggataaaccatttatccatcaccagaccatcctgatgccacttgtcgtcgtactcctgcatcagcgcgtcacggcaaggcagctgtgcagcaaccgctgcagaaagcgctgccagcgcatcggtcatattgtttgcttcatggtattgcttgctcaccagcacgtcagccagatgcgtttcaccaaaagcaaggaagcgcaggcaggcattacgcagagtgcgttttgcaatatcttcatgctcaacacggtactcgctctggtaattcgcgttgtaaatagccagtagctcatccgccagttcagtcgccagagtacgagtgagtgcttcgcgtacttcagcaatagcaatcgggtcgatgatatcgaacagttctgccatttcattgacggaaggcagcgtcaggatttctgccgccagtgccggatcaatcttctcatcaagcagtaccgcgcggaaagcatcagccacatgcaccggcagagacagcggctgaccttgctgatgacgcgcgacgttcagcttgatgtaggttgccagcaggctttgcgccgcatcccagcgggagaaatcattacgcgcatgacgcatcaggaaggtcagttgctgatcgctccacttatattccagtttcactggcgcagagaattcgcacagcagcgcaggcaccggctgaaagtagacattatcaaagacaaaggtctgttccgcctgggtgacgttcagcaccgaattcaccggatgaccgcctttttgcaacgggatcactttgccttcgttgtcatacagttcgatggcaaacggaatatgcagcggctgtttttctgcctgatccggcgtagcaggcgtacgctggctgatggtcagggtgtactgctcagtttccggattatagtcgtctttgacggtcacaaccggcgtaccggactggctgtaccaacggcggaaatgagagagatcgacattcgacgcatcttccatcgcctgcacaaagtcgtcgcaggttgccgcgctgccatcatggcgctcgaaatagagctgcatccctttctggaagttttcttcgcccagcagggtgtggatcatgcgaatcacttccgcgcccttctcgtaaacggtcagggtgtagaagttgttcatctcaatgaccatatccgggcggatcgggtgcgccatcgggctggcgtcttccgcaaactgcaatccgcgcatggtgcgcacgttgttgatacggtttaccgcgcgggaaccaaggtcagagctgaattcctgatcgcggaacacggttaaaccttctttcaggctgagctggaaccagtcgcggcaggtcactcggttaccggtccagttatggaaatattcatggccgataacacgctcaatatcgaggtaatctttatcggtggcggtgtcggtacgggccagcacatatttggagttaaagatattcagacctttattctccattgcgcccatattgaagaaatccaccgcgacgatcatatagatgtcgaggtcatactccaggccgaagcgttcttcatcccatttcatggagtttttcagcgaggtcatcgcccacggcgcgcggtcgaggttgccgcgatcgacgtacagctccagcgccacttcgcgaccagaacgcgtggtgaaggtgtcgcgcagcacgtcgaagtcgcctgcaaccagcgcaaacaggtagcacggtttcgggaacgggtcctgccactgtacccagtgacgtccgttttccagttcgccttgcgcaacgcggttaccgttggaaagcaggaagggatatttggttttatcggcaataattttggtggtaaaacgcgccagtacgtccgggcggtcaagataatacgtaatatggcggaaaccttcggcttcacactgagtgcaaagcgcatcgcctgactgataaagcccttccagcgcggtattcgtcgccgggctaatttcattaacgatcttaagcgtaaaacgctccggcaaattactgatgaccagtgcgccctcttcttctttccaggcggtccacggctcatcattaatatgaacagaaaccagtttaagatcttcgccatcaagacgaagcggagcatctgatgcaccatgacggacagcctggctgaccgcggtaacgaccgtcttttgcgcgtccaggtcaaaggtcaagtcaatatcagtaatctggtaatccggcgcacgataatcgtgacggtatttggcttgtggctgttgagtcataaataacctttagcatctttgatagagtctggtgttcagtctattcctgttgcgtaaatcgcgctatgcagaatcttcatcttttcaggtacaaacgcctttattgctacatttttataacatacaccgcgtaatgccatcgaccagaaaggtggcatatggtgtgatcggggttcaataaattgcgaaacaaggtatactccagcagttcctgaagatgtttattgtactaaacgctcctgtacgaggacgctactgcgcacctatgacacaattcgcttctcctgttctgcactcgttgctggatacagatgcttataagttgcatatgcagcaagccgtgtttcatcactattacgatgtgcatgtcgcggcggagtttcgttgccgaggtgacgatctgctgggtatttatgccgatgctattcgtgaacaggttcaggcgatgcagcacctgcgcctgcaggatgatgaatatcaatggctctcagccctgcctttctttaaggccgactatcttaactggctacgcgagttccgctttaacccggaacaagtcaccgtgtccaacgataatggcaagctggatattcgtttaagcggcccgtggcgtgaagtcatcctctgggaagttcctttgctggcggttatcagtgaaatggtacatcgctatcgctcaccgcaggccgacgttgcgcaagccctcgacacgctggaaagcaaattagccgatttctcggcattaaccgccggtcttgatatgtcgcgcttccatctgatggattttggcacccgccgacgtttttctcgtgaagtacaagaaaccatcgtgaaacgtctgcaacaggaatcctggttcgtgggcaccagcaactacgatctggcgcgtcggctttccctcacgccaatgggaacacaagcacacgaatggttccaggcgcatcagcaaatcagtccggatcttgccaacagccagcgagctgcacttgctgcctggctggaagaatatcccgaccaacttggcattgcattaaccgactgcatcactatggatgctttcctgcgtgatttcggtgtcgagttcgccagtcgctatcagggcctgcgtcatgactccggcgacccggttgaatggggtgaaaaagccattgcacattatgagaagctgggaattgatccacagagtaaaacgctggttttctctgacaatctggatttacgcaaagcggttgagctataccgccacttctcttcccgcgtgcaattaagttttggtattgggactcgcctgacctgcgatatcccccaggtaaaacccctgaatattgtcattaagttggtagagtgtaacggtaaaccggtggcgaaactttctgacagccctggcaaaactatctgccacgataaagcgtttgttcgggcgctgcgcaaagcgttcgaccttccgcatattaaaaaagccagttaatatcatcagggagctaatcggctccctttttttacctttaattccgaaatctttcgctgcatttgcgaattctgcttgtctgattgcagatgccaggtaacataggtatccccccatttacgggtggacaagtgtttattttttccgactattaacagagagaatattatgagcgttgtgcctgtagccgacgtactccagggccgcgtagccgttgacagcgaagtcaccgtgcgcggatgggtacgtacccgccgagattcaaaagctggcatctccttcctcgccgtttatgacggttcctgctttgatcctgtacaggctgtcatcaataattctctgcccaattacaatgaagacgtcctgcgtctgaccaccggttgctcggtcattgtgacgggtaaagtcgtggcatcgccgggccaggggcaacaatttgaaattcaggccagcaaggttgaagttgctggttgggttgaagatccagacacttacccgatggcggcaaaacgccacagcattgagtatctgcgtgaagtcgctcacctgcgtccgcgcacaaacctgattggtgccgtcgcgcgcgttcgccatacgctggcgcaggcgctgcatcgcttctttaacgagcagggattcttctgggtttcaacgccactgattactgcgtctgataccgaaggggctggcgaaatgttccgcgtttctacgctggatctggaaaacctgccgcgtaacgatcagggcaaagtggatttcgacaaagacttctttggtaaagagtctttcctgaccgtatctggccagttgaacggcgaaacctacgcttgcgcattgtccaaaatttataccttcggcccgactttccgtgctgaaaactccaacaccagccgtcacctggcggaattctggatgctggagccggaagtggcgtttgctaacctgaacgatatcgcgggtctggctgaagccatgctgaaatatgtcttcaaagcggttctcgaagaacgcgctgacgacatgaaattcttcgctgaacgcgtagataaagatgccgtttcacgtctggaacgcttcattgaagccgattttgcgcaggtggattacaccgacgcagtgactattctcgaaaactgcggcaggaagtttgaaaacccagtttactggggcgttgatctctcttctgagcatgagcgttatctggcggaagaacactttaaagcaccggtagtggttaaaaactatccgaaagatattaaagcgttctatatgcgccttaacgaagacggtaaaaccgttgcggctatggacgttctggctccgggcatcggtgagatcattggtggctcccagcgtgaagaacgtctggacgtgctggacgagcgtatgctggaaatgggcctgaataaagaagattactggtggtatcgcgatctgcgtcgctacggtactgttccgcattccggtttcggtcttggttttgaacgcctgattgcttacgtaactggtgtgcaaaacgtgcgtgatgtgattccgttcccacgtactccgcgtaacgccagcttctaatttagcgtcttcaagagccagcacccgctggctctttttttatcctttctgtcaagttatctgtttgttaagtcaagcaatctatttgcaaccccgccataacgatcatcctgttacggaatattacattgcaacatttacgcacaaaaaataacccgcattcttattgcggattagttttttcttagctgatagcacaattttcatactattttttggcattctggatgtctgaaagaggattttgtgccaggtcgataaagtttccatcagaaacaaaatttccgtttagttaatttaaatataaggaaatcatataaatagataaaaattgctgtaaatatcatcacgcctctatggaaatatgacggtgttcacaaagttccttaatttttacttttagttacatattttttctttttgaaaccaaatctttatctttgtagcactttcacggtagcgaaacgttagtttgaatggaaagatgcctgcagacacataaagacaccaaactctcatcaatagttccgtaaatttttattgacagaacttattgacggcagtggcaggtgtcataaaaaaaaccatgagggtaataaataatgatgaagcgcaatattctggcagtgatcgtccctgctctgttagtagcaggtactgcaaacgctgcagaaatctataacaaagatggcaacaaagtagatctgtacggtaaagctgtcggtctgcattatttctccaagggtaacggtgaaaacagttacggtggcaatggcgacatgacctatgcccgtcttggttttaaaggggaaactcaaatcaattccgatctgaccggttatggtcagtgggaatataacttccagggtaacaactctgaaggcgctgacgctcaaactggtaacaaaacgcgtctggcattcgcgggtcttaaatacgctgacgttggttctttcgattacggccgtaactacggtgtggtttatgacgcactgggttacaccgatatgctgccagaatttggtggtgatactgcatacagcgatgacttcttcgttggtcgtgttggcggcgttgctacctatcgtaactccaacttctttggtctggttgatggcctgaacttcgctgttcagtacctgggtaaaaacgagcgtgacactgcacgccgctctaacggcgacggtgttggcggttctatcagctacgaatacgaaggctttggtatcgttggtgcttatggcgccgctgaccgtaccaacctgcaagaagctcaacctcttggcaacggtaaaaaagctgaacagtgggctactggtctgaagtatgacgcgaacaacatctacctggcagcgaactacggtgaaacccgtaacgctacgccgatcactaataaatttacaaacatcagcggcttcgccaacaaaacgcaagacgttctgttagttgcgcaataccagttcgatttcggtctgcgtccgtccatcgcttacaccaaatctaaagcgaaagacgtagaaggtatcggtgatgttgatctggtgaactactttgaagtgggcgcaacctactacttcaacaaaaacatgtccacctatgttgactacatcatcaaccagatcgattctgacaacaaactgggcgtaggttctgacgacaccgtagctgtgggtatcgtttaccagttctaatagcacacctctttgttaaatgccgaaaaaacaggactttggtcctgttttttttatgccttccagagcaatctcacgtcttgcaaaaacagcctgcgttttcatcagtaatagttggaattttgtaaatctcccgttaccctgatagcggacttcccttctgtaaccataatggaacctcgtcatgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaagctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccgggtggcactggcgcactacgcgtggctgccgatttcctggcaaaaaataccagcgttaagcgtgtgtgggtgagcaacccaagctggccgaaccataagagcgtctttaactctgcaggtctggaagttcgtgaatacgcttattatgatgcggaaaatcacacccttgacttcgatgcactgattaacagcctgaacgaagctcaggctggcgacgtagtgctgttccatggctgctgccataacccaaccggtatcgaccctacgctggaacaatggcagacactggcacaactttccgttgagaaaggctggttaccgctgtttgacttcgcttaccaggggtttgcccgtggtctggaagaagatgctgaaggactgcgcgctttcgcggctatgcataaagagctgattgttgccagttcctactctaaaaactttggcctgtacaacgagcgtgttggcgcttgtactctggttgctgctgacagtgaaaccgttgatcgcgcattcagccaaatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggtctgacaaaagaacaagtgctgcgtctgcgcgaagagtttggcgtgtatgctgttgcttctggtcgtgtgaacgtagccgggatgacaccagataacatggctccgctgtgcgaagcgattgtggcagtgctgtaagcgttaaaaacaatgaagcccgcttaaaaagcgggcttttttatgcgcctttaccagacgggcatttcgtcttgcaggaagggattatgcagacgctcataaccaagtgtggataatggtccgtgacccggaataaatgtcacgtcatcccccagtggcagcaacttatctttgattgaagaaatcagttgattatgatcgccacgcgggaagtcactgcgccctactccgcctttgaaaataacgtcgccagaaatcagcagctttgcccgatcatcaaaaaacacgacatgacccggcgtatgcccagggcaatgtaacacctgtaaagccacattccctatgctgatggtatcgccttcgttcagccaacgatccggcgtcagcggctggcactcttccagaccaaacatacgactttgcgcaggcaagccttgcagccagaactcatcttctttttccgggccaaaaaccggcacgccgtaatgttgcgccagttccgccgctgcaccaacgtggtccagatgaccatgcgtcagcaggatctgcatcagtgtcaggccgctggcgtcaacttcctgtttgattttttccgcatcgccgccaggatcgaccagtgcggccaagcgggtttgttcacaccagatcaatgaacagttctgggagaatgcggtgaccggaataatacgatagttcatactgcccctgtttcgttaagcaattgctaccagtgccgtgctggcccggtatcaatatgcacaaagttactacgtgggtaatatcctacaccacctgcgcgcatagataacgcggctttgcgaatattgcttaacgcgataccttcaatatggaaatccatcgcctgccctttcgtgtgatagcttttcttcgctactccacggctgcgggcgcgtagttcattgttggtatcaatggaacgataaccggaaatgagttgcaccggtttgcgggtacctaataacccttgcaggcgatacaactgatcgaataatcctgggtcgatggactttattttgttcgcgcggtaatcgcggaaaaaatggttaagttttgccaattcttcctgaatatagcctctgccatcgaaaaactccgctttgattgactctccggtatgaagattattgagtgtcaaaatgcgcgggcgtggggtagagagtgttgcaaacgcaggagtcggcaggatggcggcaccgagtgcaacgccaccaagcgccagcagtttgcggcgattagcgtcgaatttgtccatgataatcaagtctacaggtcaatgttatcgtttatatgcacttctggcgcacaagaggcaccttaaccgcccgtaaagcagacgtcaagatgactcaaccccagcagtgacgggggctgcagagaatcgcccccgatcatgctaattattacgacaactgatttccccgaactgcttcatttacctgattaattgttccgctttcgatacgatttgcgagctggatcgcgcaggtagatcataattgtaaatatctgtacgatactgggtacgaccatctgcaccaacaaaggccgtcaggtagtagagattcaccggaatcgactgccgaatattgacgtaacgcgtatcgccttgcttcagcgcatcagaaatacgtttgtcattccatcctgcatcctgcaacagcatattcgccagatcggaagctttattcactcgtacacagcctgagctcaatgcgcgtgtatcacgcttgaacagattgtggttcggcgtgtcatgcaaataaatggcctctgaactcggcatattgaatttatagcgccccagcgagttccgtgggcctggagcctgctggaagcggaacggtaaattcgaggccgtgattgtagaccagtcaacctgccatgggtcaatcgcttctctgctgttccagccgcgcatcaccgtatagccatggctttcgaggtatcccggatcgttgcgcactttcggcagaatatctttgcgtgccagagttggtggtacgttccacggcgggtttaccactacgttgttaagtgcactgctcatcatcggcgttttgcgatcggggcgaccgacaatgactcgcgaatccagtacctgattgccgttctgatagtagaccagcgaataggctggaatgttaaccatgatcccggtagaaagctctgttggcagcaagcgcaatcgctggatgttgagtgccaacacgccagcacgctgggcgggcgttacgtttaaccagtcacgcgttgccgggccaatagcgccatctgctcccaatccttgccatgcctgaaaacgtttaacggcttccaccagttcattatcgtaggcggcacgaacggcaggcgcaggtttactacgagacgtcgtttgcttgtccatcggcttagtttctgctgtttcaacagtaacagcggatgggctgactaccgtgtcagttggcgtgtcatcgccaggtagagtaattttcggccccccgtccaacatgcctgtgcgttgcaatatttcgcgcaacgccgctacgtcgttactccactgccctgggcgcaacgttgctttaccggtcagttgaggccacggtttggtgtcactgagtaaggccagtaacgattcatgcatcgccgcatattgcggatgctgcggtgccagtcctgcaacaaacgtcggcaattgacctttatccagcgccagctgccattggttaatcaccgaaagcggcggcgttgcaagcgcataaggtttactgctatatagccagcgagtgcctttgaccggaatatttgcaatgaaatggagatagcccatcatcgcatcagagagcacgacgtcgcgtgccatcccgttaacaccaggatcggtcagtaactctacccatttattaaactgcggctggaaaccggcaatcgccacctctgccagctgttgctggaaggctttaacagcatcacggttttcccacatgggttgcatatcgcgtgcggcatacaacagttgaagctggttaagataaaccggcttgtaacctgcgggtaattgagattcgatttgcgtgcgggctttttctgccgcaccttcaggcaatggctggatccccgccattattgccgtggcttgcgcctgcggcagtgcctcgccctgttcactgacagccaccgggctgtcgccagggattacttcaggctcatcggcctgcgcattgaacagtggagcgaatgttacggccaggcacaaactgattgccgacagccgacgaccacacatcatattaagcaacatcccttgccccctgtttttatcatactctgaatagccaggctgttattttacgacttgcctgtacaacgccaatactcacgaaagtatgacgagcaagcctgttactcatcaggcttatcttcagtatataaacgccgatacgtttttacataacctaatgtaaagaagtttaaagaaaagcgcgccgtaatgtgccacttttttagtgcagaaacggagttttcggaaaaagaaaaggcggcattgctgccgccttcattttaactcgcctgggaaggcgcttcgtcacttcctggaagcgtttcagggagttgcggcgcaaatcctcgcaggccgacgacgtgaacgtgttcggtattctggaagactttacgtaccagtttataggtggtgcctttttccggactgatattttccggcgctgcgatgatgagctgcatttgcaaacgttcacacaattcaaacagcgtggcgatagaacgggcgtccagtcgcgcggcttcatcgaggaacagcaggcggcaaggagagatatctttaccgcgcaggcggcgagattcatcttcccagctttgtaccaccatcaccagaatcgacataccggtaccaatcgcctcaccggtcgacaatgcaccagactctgcgcgcagccaaccatcagaaccacggttaacctcaacttccatttccagatagttgcggtaatccagcagttcttcgccaatggtctgcggcgtgcgctgccccatatcaatctgcggattaagacgttgatacaatttcgccagcgcttccgagaaggtcagacggttgctgttaaacagatcctgatgctgctcgtgctgttcagagagcacatccagcagcatggcgtgcgtttcacgcacgttcacgttcagacgtacgctgttcacctgaccaaacgatacgttctgcaaaccctggttgagcatacggatacggttctgttcgcgctgaatggttttgcgaataatgttcgccacgctgcgggaactgatcgccagtttctgttcacgggaggttaactcttcggtcagacggctaagttcgatctccatctgttcgatagcttccaccggatcatcggtacgaataatatcctgacgaatacgttcacgcagatgctgataaaccgccacgaagaactgaattttacgttccggacgttttggatcttccgacatgcgcagcacatcgcgcagatgttcgttatctgccactgccagacgcagcgcacctaacgccttatccgacatggaacgcaaatcatcagcggagagataagccagctcacgacggtgtaagcggcgctcaacgccgttatctttcaccatgcgcatgactgcacaccagcccgctttcgcggtcactacctgctcgcgcatctcaaagtaatcccgctccagcttgcgcagtttgcgggtcaggttgtccatctctgcttcgcagaaggtaagcgctttttccagttgattgcggcgtgaacggttattgctcagttgcgcgtgcagctcgtcacggcgaatacgcgcccgctcttctgccccgctatcagctcgcacgccgatatcctgcaattcacgttgcagatcattgagtagctcttttttggtgtcgtaagaacttttcagcgaagccagcacctggttgtactgactcaactgcgctgcgtgtccgcgcaacgcttcacgcgcgcgggtacgctccgcttccgcctgttccagacgttcacgcagtttttcgttgagatcgctgttaccgctaagcatttctgcagagtcagagtagctaaagtgcgcacgacgctgcaccacttccgtcagggcaaacgcctgctgacgggcatcgcgctgcatctgctgagagtacgcgtaatcttcttttaactgttcgaactgttccgggtcactctgcaataccgaaacgatcggttccagtttcgccagttgattaccgaactgctgaacaaaacgcgcggcttcctgggcttcatccagacgttcgcggatttcatcgacgcgatctgccaggctgtcatcagccaacaggttgagacgcggcagaatgcggttcagcgccgtaacgccctctttcgcctgctcaaattgaatacgctgctgctggttatcattttcatgattactcagcgcccgctccagttcgacgcgacggctgttcagttgacggatttctgcttccgggtcagactcaaacgccaccgccagatgactaccgataaagcggctgaacgcctgatgcagacgctgggttttctgtacatcaaaggagagcgtggcgaagcgttcggaaagcacttcacgctcggcatggaggctttcgatgcggctttcgcgcgccgcgcgtccaaacagcggcacttccgggaaacgtgaataacgccactgacgatcggcgattttcaccactaccgctttttccagctcatcaacgctgaacacgctgtcatcgaatgactgcggatccccttcgatcagatagagatcttccgggcaatcggtcaagccttccaggtgttcggttacctgtgacagatctggcaccacaatggcgtggcgtgacgggccatacagcgccgagaagtacggcgcatcttccaggctaacgtcgtcataaatttctgacagcagcacgccgccaaaacgctccgccagcgcattcaaacgctggtcttcagaaccacctggctggcttaaacgttcgatctcttcatcgacggcgtttttgcgcgcgcctacttcatcgcgttcaacaatcgcctcgcgctcacgctccagcaactgttgcagatattcggtgacgtcctggctggaggagaactcttcgccgcactgttcgctcaactggttgagactgttttgcgcagccagccaaaccggcgcacgctgcatcaaactctgaatgcgagactgcagctgttcctgctcctgacgcagtgccatacgctcttcgcgggcgttagacacgctatcggaaagagaggcaatgcgcgcttccagctcctgatgcagagcttccagttcatcaatatcaaaattcttgccctgacgtttgcagaaatctgccagcaggcgttcggcttcttgctgctcgcgcagacgctgttccagttcgcttaagcgcatccgcaacggttgaacctgctctgccaggtgacgctgatcgaccccttcgcgcagcagttcgcgagcgacatcccacgcctcgttacgcgccagcgggccgttgattgccaccaccagctgataagcctgctcaaactggctgtgcgcggtttgcgccatgctcattttctgctcaagagagagcattttttcagtcgcttccagctctttcgcctggaaggtttccagccattcggcggcgctgtcggcggttaagtccggcagatggcacagttctttggcacgattaagcgcagcaaccgcctggttatactggatcgcgcgcgtttgctggacgtccagcgcctgctgatagtcagcaagctggcttttcagctcgtccacttccagttcggcagcttccgcacgagcctcgttctcttcctggcgttcgatggcttctgccaccacttcgttttgctcttccagacggatctgcagctcatcgagatccgcttcgtaacgttcgatcttctcctgctgacgcagtgcggtttgcaccaggttcaggtgatcgctggccgcctgataatctgcttccagatcgccttcggcaccgttgtgctctgccagctcacgcgccatatcgacgtgtttgtactgctcagccgccagttgctgacgcgaagtgtgtagctcgcgacgaaattccagggctttgtcgagatggacacggcgctcgttggcgtgacgcatgtagtccgccgccacgtagttggtggcttcgctgatcagatgcttaaacaggtcacggtccgactgggtgacacgaatcgcttccagcgtcatgcggttttcgcgcagcgccgcttccatgtcctggaacgctttccgcacgccgctgttttccggcaacaggtagtcgcgcagagagcgcgtaatggcgctggagatcccgccgtacagcgaagcttcgatcagacgatagaatttgctacggtcagacgctgagcgcagacgacgcgcgatgatgcccagatcgaacatcagcgagtggtaatcggtaatggagttgaactgcttaaactgcacgccttccatcgcctcgagcttgtctttcagctcgttcagcggcagtacacgcgcctggcgttcgttgagggtttcggtcaccagctgcgtcggcagcaccgacatcggcaggccctgaatggcaaacggtttgatatcgactttacgatcgcgtccggcaacctgttgcagacgcacaccgaccaccacacgctggtggcgcgagttaatggtgtcgagcatcgaataacagacacccgctttcagcttaccgtgcagacctttatcgcgcgaaccgctggtggccccggcttccgtggtgttacggaaatgcagcagggtcaggtcggggatcagcgccgtaacgaacgccgccattgtggtggatttacccgccccgttaccgccggagagcgtcgtaaccagctcatcgaggtcaaaagttcgggcaaaaaagccgttccagttaatcagcgtcagtgagcgaaatttaccgcgttcaatcattattcttcctctccgctatctggctgactctcttcggtttcatcgttgagttgcagatgattttcaatcggcattgcttcgccatcacgaatcaggcgacgctgtgcttcacggggatcgtcgccagcacgcacatcggctccgaagcggaacaccgattcggtaatgcggaacttgctgctgtcgtggcccataaaccacaccatacccaaacgacgcagacggttgagcgaagaacgtactttttcctgcaacttctggcggtcaacgtctgaaccggttgaacggttgttcaccagtttcagcagtttcgcttcatcggccagggtgagcagttcgtcgtacagttcctgctgggtgaaaatcccctcgttcgccagccgttccgggctgagatagagataacagaggattttcccgaccatcatatccagttccgacaagacggaacgcgggataagagtggtggaacgtgggcgtaaatagaagaacccttccggtgcacgaataagctcaacgttataacgcgcgtaaaactcttccagatattcctgaaaatccatcaggaatgcatgattatccagttcgtcgaggccaatatggcggcctgaacgtaaggcgctgtccagcgccggaaataacggattcgccagcgcctgcgccagcttaaccggcatcacttgttcaatatttgtcgatgacatgcgcctgtaccttggctccgtaatcattaatcggctgccatttcgctggcagtccggtgaaatctgcttgcgctacgccaagacgtaccgcctgatcaataacaatgcgcgcaacgtcaaagtgacgtgcacgcggatactgtgacagatattcgcgtaccaccagaccaagatccagcggcacttgtctggttttgtacacggcaagttgttcttcaatgatcgccgccagctgttcgcggatctcgttaaactcttcgtactccagatcctcaggaagttctcctgtcacttcttcatcgcgcagagccatctcttcgtcacgcatatccagcagacgatcggcattggcataagttagcgcccacggctcatcaaaataggtttgtaccgactgacgtaaccgctgagcaaagacgcggtttttatccatatcgatcgcagtacgaataaatttgtgtacgtggcggtcgtagccaatccacaaatcgatggattgctggccccagctgataatacggtcaagtttgctctgcagatcgaataccagacgatcgacaaaatgcagatcgtcatgggtcatcgtcgcatcctgaatgcgtaacaggttggcctgcaatttatcgcctgccgcttccagcgtatcctgcaattcacgcagcgtgccggaagtttctgaaagcaacaattcacagctggaaatcgccgcccgccagtctttgttcaacaactgggcgatatcatccttcacctgctgctgctgttcatccatcagacgttgcgtcaggtcgatactgtcgaaaatttctgctaccgaatatttcagtggcgcataaacattacggtgccagtgaaattcatcaccgccctcttcggcggcatctgctgcgcgtttgagctcacccgccacaatcgacaattgcatagaaaggcgcagcgtagaaaactcgcgctgacgaatgtaatagtcagtgatgccaatgccgagcggcgtcagacggtaaattgcgttcccttccgcctgctcgctggtaaagcggttcagcagacgttgacgcaccatgtcgttgatcgcgttgttggcgcgcacgccgatggtttcgctggtttgctcaaacgcatcactcacatggcggaatgcatccaccagctcgccttcactcatctcaccatccagacgctcgccgttcagcgtggcaaccgccagcagaaaagagagtcggtctaccggcagcgagatggagaagtcattttttctggcccaggcaaccagttcggggactgtctgggaaaattcactcatactttatccttgctctgcggtttgcgcgcggtgacatgaatataacgccccagggtaatatacggttcctgacggcaataacgcgtttctaattcaagtaatgcttcatagcagtcgcgctgctggtgcttctcgcgcagataatcatgaaacacgcgaacgcctgtcttacccataatttgccaaccagcttcttccagccacagataaacctgcgccgggtcgcgtggataatctggcgaaagcgtccgttttttctttttcggcattcccgcctgcacgtaatcaaaattcccggcgaccatgttatgcatcagcaagccgtgcgcattgtagaacattaacgacaacacaccgcctggacgcaacactgaccacagggtctgtaatacgctgcggggatcggccacccactcgagcaccgcatggaacaatatcagatcaacgggcgtttccaaatgcgaagcaacatcctgagcggcgcaatgtataaattgcatgttgtcgctcacaccttttgcttctgccgcctgttttgcgcggtcgatcatctgcgcagaaagatcgcataaaatgacctgatgcccgcgctcagccattttgattgcggtctgcccttctccaccgccagcatccagcacacgcagtttttgcgggcccatttccgccagcacgcgatcgagatcctgccacagaatagcctgtcgaagctgccctttggtggtgccgtaaatgttacgggaaaacttttccgcaatatcatcaaaattgcgatcctgcattgctttctccaccggttggctaagacgttttctgataaagacgctattttgtcacagccacggcgagaatgaacccgtctggtgtaatatcgctggcgatcccttgctatatggttaaaaaaggaaccagaaaggatgctttttacactgaaaaaagtgattggcaatatgttgctgccacttccgctgatgttgttgattattggcgctggcctggcgctgctgtggtttagccgttttcaaaaaaccgggaagatttttattagcattgggtggctggcgctcttgttattgagtttgcaaccggtagccgaccgcctgctgcgtcccatcgaaagcacctatccgacatggaataattcgcaaaaagtggactatatcgtggtgctcggaggtggttatacctggaacccgcagtgggcaccaagctcgaatttaatcaataacagtctgccccgcctgaatgaaggtattcgcttatggcgcgaaaatccgggatcaaaactgatcttcacgggaggcgtagcaaaaaccaatacggtgagtacagcggaagtaggtgcccgagttgcgcaatcgctgggcgtgccgcgcgagcaaattatcaccctggatttgccaaaagataccgaagaagaagctgcggcagtgaaacaggcgattggtgacgcccctttcctgctggtgacctccgcatcacatctgccgcgggcgatgatcttttttcagcaggaagggctaaatccgctgccagccccggcgaatcagttggccatcgactcgccgcttaatccgtgggaacgggcaatcccttctccggtttggttgatgcatagcgatcgtgttggctatgaaacgcttggccgcatctggcagtggctaaaaggttcgtcaggcgagccacggcaagagtgattttgatgccagatcgaagttgcgccgactaaatcgtccggtattaaccagttgcgcaacttcatcccataacacatacaaccaacgccgccagatgaacgactccgccactggcgcgcgttgcaggtaactccagagcaaatcttccgccagagaattatccattagtcggaacagttcatattctcgcggtgcccaaagcattagtcccggcccgaccatcgccagtaactgatcgctgcgcgaatctttcagcatgctgcgtaaacagaagttaccgtgaatcagcacacaattgtcgttaaagccttcaaataatgccgggagacattcgcgagtacgaaacaggatccgcttatcctgcatcgttagaccggtgttattgaactgattgagcgtggtccatagcacttcaacatgttgccggtaccatgagggccagaaattttcctgagtattgtcgaccgcgccgacgcaaccgcgactgtcctgacggtgccaggccagtaaggcttcaacgatttgatctttaagctgttcccagcgttctggtgttcgggctggtgcctccaccgaaacaccacgcatccgctccagtagcaggacatcggggccagggtgttcttcatgcgtcatcacaccataaataatcggcatacggacagtcccacttcttgccagcatggtggttttccatgccagttgtcgggcttttccgggcgtactaaagcttcttgccattaacggcattgggtttccctggctgtcatacaaagcccacaacgccgtatccgctttttcattgacgcactcaatacgactgagtttttcgcccagtaaatggcttaattcggcacgcagctgttccattcagattaccctcataaaagctactgctttcataatgagcgccaatataaaagatgtcacctgaatgagatcaattgttgaaaagaaaaattgaggaaaatcgtaacggtacgacactcctcccaaaattggctggagtgtcgtgaagtgaaattagcgcatttcagcgcgaacgcgctcgagatcttcaggggtatccacacctgtgccaggaacttcctgggcgacagcaacatggattttttcgccgtaccacagaacacgaagctgctctaacatttcgatgtgttctaacggacttggctgccagttgacgtaacgacggataaagcctgcacggtagccataaataccaagatgacgcaggaagttatcgccaacggtttcaaggccttttgcaaaacgatcacgatcccaaggaatggtggcgcgagagaagtacagtgcatacccttcagcgtcgaggaccactttcaccgcattcgggttaaacgcttcctccgcattgtggattggcaccgccagagtcgccatacccacctgacgctgggcgagattatcagcaacctgacgaatgattgtcgcagggatcatcggttcatccccctgcacattaacgatcaccgtgtcgtcgctgaatgcgcatttttcgacaacttccgccagacgttctgttcctgactgatgatcggcgcgcgtcatacatacttcaccgccagcggcttcaacagcgcgagcaacatcctcatgatcggttgccacgatgatgcgctcggcacctgattcgcgcgcgcgttcaagaacatgaacaatcatgggtttgccgttaatatcaaccaatggtttaccgggcagacgcgtggacgcgtagcgcgcgggaataatgaccacaaaactcatgatttactctcatcagcagtcagcacgcgggcttccgtttccagcaacactggaatgccatcgcgcagcgggaaagccaggttgtccagtttgcaaataagttcttgtttttcctggttataccaaagttttccgttgcaaaccgggcaggcaatgatttcaagcagacgatgatccatagttcctccagatggatcgggttatgaatgcataaatcttatcataatcatttatgcgacggggtctatttcccagccggtgcggcaatcagtaaagaggccttgcgggcagcgtcctaatgtcacccgcgttgcctgctgccagttagcgaaatcagtaatcgcctgacgtaaccctttttgcagcgttgtcgttggtttaatgccttcctgtaaccacagagagataacttcaaggatgcctgtctggcgatgcattttggcatccattcgcccaactaattgcccacgatgtaataacggcagaacaaaatagccatactggcgtttcggcgctggggtatagcactccagccggtagctaaaatcaaaaagctgctctgcgcgtttgcgatcccagacaacaggatcaaaaggcgaaagtaccgcgctgtgcgttgcagtgagctttccggccagcgcacgctcgagtagcggcagcaaatcagcatgcagccaaagattgcccaatttttcaacatgcacagcaatgatttgctgctgttcagccctcgcttcgcgccacgccgccagtgccggacgtttcagccgatagtaatctgccagccactgttcgcggaatattcccaggctacgcgcactgttatccagcatgatgatttctgcttctgtttgcgaaacgagatcgcgctcatcatcccagtcaggcatgactcggtgggttaaatcataaacgcgctggaagttgcgccgttcaatcaccatcacctttccggcagtaaataaaccttccagatgccgtttatgcggcttccattcccaccagccgcttgcacctttacgaggatgctcaaaatcggctgaacgtaccggccccttatcatgaatatgctgaattaactgtgcaatttccgcctcatgttcctgcatccaggcgtctttgtatttccagcccattttttcaggtgccagcatgcggtggcgaataagacgaaagtcgctacgcggcataaagcaggcttcatgcgcccagtattccattaattcgccacgcgccagagactcatccagccactgggcaggataatttcccagacgactgaaaagcaccagatatggactacgggcaacaatattaatggtatcgatttgcagcaaggacattcgggagatcgttgccggaatatcctccaacgacgctcgacggcggggtttgtttaacaggccttgcgcggcgaggtgaagattacgcgcatcagcaagagagaggtgcggcagcgacattcatgactccatcaatcgaacgctgccgcggcgtaactagttgccagaagccagcgaggttagttgcgcaagcagtttcgctggttcatcacctgaaagctgtgcgtctacaggcaaataccaccaattttcttctgcaaaggcccggcatttcaccgcatctttttcagtcattaccagcgtttgcccggcgcttaccaacgcgctgacatccgcatgattcaaagactgatgatcggccagcggtacacatttttccggttgtacgccgcacatcttcagcgtggcaaaaaagcgcggcggatgtccaatccccgccatcgccactacatgttcaagctgagcaacgtcacaacgcataccggtacgtaaattcaccgcctgacccggcagcagatgcatggggatttcaccgctgcgtgggacaccgccgttgacgattaccgcatcaaccgactttaagcgccccgctcgctcacgcattggccccgccggcaaccaccagccattgccaaagcgacgcacaccatcaacaacgacaatttccacatcacgcgccagacggtaatgctgtaaaccgtcgtcggttacgatgatctgcacatcagggtgttgcgccagaatggcttttaccgcatcagaacgcacgggagaaaccgcaacgggcgcgccagtgcgttgataaatcaacacaggttcatcacccgcctgtgctgtggtggtatctgccgacaataacagcggataagattcagccttaccaccatatccccgcgatactacccccacgcgaataccgcgctgttgcagctgttccaccagccagacaacgaccggggtttttccattgccgcctgcggtgagattaccaaccacgacaaccggtacgggggcacgccaggcgcgcttcagttttagtttatagcaaagacggatcgcgccactcaccaggccatacaaccaggagagtggcagcaatagccgccacaaaggggattcaccagaccagattttttcgatcattggccaaactgcattttgtgaagttgcgcgtaaacgccacggtgctcaagcaaatcgttatgcgtaccgcgttccacaatgacaccatcctcgacgaccacgatttcgtctgccttttcaatggtagacaagcggtgggcaatcaccagagaggtacggtttttctgcaactcatccaatgccgcctgaatcgcacgttcagattcggtatccagcgccgaggtagcttcgtccagaatcagaatcgggctatcacgcaacaaggctcgagcgatggcaatacgctgacgctgaccgccagagagcagcacgccgttttcaccaatcactgtatcgagaccgttatccatcttattgatgaagtccatggcgtaggccatacgcgccgcttcttcaatttgctcacggctgtactgttcagtccgtgcgtaagcaatgttgttagcaacagtatcgttaaacaaatggacattctgcgacaccagagcaacctggttacgtaacgacgccagggtatactcgcgcagatcgtgaccatccatcaggatttcgccttcatcaatatcgtaaaaacgcgtgatcaggctggcgatggttgatttacccgaaccagagcgtccaaccagagcaaccgtcttccctgccggaattttcaggttgatgttacgcaatgcgggtacgtcacgtcccggataagtaaaggtgacattgcggaattccacgtcgccagtcgcacgctcgatcacgcgcttaccttcgtctttctcctgctcactgtccagaatggtaaacagcgtctgacaagccgccataccgcgctggaactgggcgttaacgttggtcagcgatttcagtggacgcatcagtgcaatcattgaagagaaaacaacggtaatcgtaccggcagtcaggttatccataacacttgggaagctcgccgcatacagaacaaacgccagcgccaaagaggcgatcagctgaatgatcggatcagagatggaagaggctgaaaccattttcatcccctgaagacgcattcggttactgactttatcgaagcgtttcgtttccacttcctgaccaccgaaaatcaatacttctttgtggcccttcagcatttgttctgcgctggtggtcacctgccccatggtgttctgcatgtttttactgatgttacgaaaacgcttcgatacaacgcgaatcgcaatcgaaacaatcggtgccagcacaatcaaaatgatcgacagttgccagctgtaatagaacatcatgatgaacaggccgatgatcgacgcaccttcacgcacaacagtaatcagtgcgccggaagaagaagaagcaacctgttcggaatcgtaggtgatacgtgacaacagcgtacccgttgactgtttgtcaaaaaatgaaacaggcattcccatcatgtgaccaaacaggcggcgacgcatagtcattaccacctttcctgatacccaggagatacagtagctggagacatagctggtgataccacgtaaaatcatcagcccgatcaccaccagcggcatccacaccagcacggagcgatctgttttaccaaagccatcatcaagaagtggcttaaggagcgataacatgaaggtatcgctggctgcgttgaggattaacgctacgcccgccacgatcagacccgctttaaaaggcgcaatggttggccacagtcggcggaatgtctgccacgtagagagatctttgtcgttatgcattcaaaaaaccagcatttgttgaaatagccgcatattctacccgttatccactggcacgccaaaccactgatgataccaacgaggtaaaatttgctctctgaggctgctaatccgccagccttgcgctgaaaaattgaccgtcacttgaccctgatgtggagtatcaagccacttataaccttgttgttgatagcgatgcttaactttgttggagggcaatcgccatgcgttatagcgcgatgccgatgcgagtgccacttttccattcactcgctgaattaatggcaacgatgatgaggtattactgccatggtgaggtacctgaagcaatgttgcctgcacttgctgccagtaacggcttagcatcttttgttcagcgggggcttcaatatcaccggttagaagaatgctattcgtcccgtcatcaaccttaaccacacaggaatggttatttcctttatcgttgctagcttgtaaaggccagtgcgcgctgaaacgcaatccttgccattgccacgcttcgccacgcacacagggctgatgatgttcccagtttaacggacttctgatccataacatcggccatgtgtgcaatattgagtccagccctccccggtgatccagatgttcatgactcagaataacgccttccggttcaagattatgccagtggagccaggggataatcagttgttgcccactatccccttcgggccaggccagtcccgtgtcatagagaatcgctttgccgtttctggctatcaccattgccagcccttgcccgacatcaagcatgtacacttgccactcgtcaggtcgaggtttttgccacagcggccagcacatcagcaagcctccagccacacacattgctggcaacgttcgccaggcgtttaatcgccataccaccagtaagaaccatggggaaaatgttagccattgccaacgttcagcaatgttgatccacccttccggcaaactctttaacccccagaaaagtaaagccaaagaccggtcggcaagaaaccataacccctgttccaggattaacggcccgcttaaatgcacaaccatcgcggcgaggatcaatggaaccgtgataaatgtcaccaggggaattgcaaatagatttgcaataaacgaggtcagactaatgccatgaaatatgacgatttgcacgggcataagcaggagggtgattcccagctgcagatggatgagggaaacaaccgcgcgcaataccggcggcagttgccactccggacagggaaaccactgataccaaaaaatcagtgccgcgaccgcagcggcagagagccataaactttgcgagagaatggcaacaggatccatcaacaaaattgccgccagacaacatatccatacatcccagccactccattgtcgcccacttaacttaagcattccccacatggcaagcgccaccacggtacgcaatgcaggaggttgcatcccagtcagccaggcataaaaagcagcacagcagattccgccaattaatggcatttgccattggatccagcgcccgggcagaaaaacttgcccaccgcgaatgagtccggcagccagcaacgccgcaaaagcgatatgcaatcccgatatcgccattaaatgcgccgttccagtatcgcgcatgatatttttgatttctttgggaacggataaccgttcccccatacctaaaccaagaataaccgcattccacatatagggttgcagcgttgtttgtaatgacgccagatactgtgcacgcaggctacaattcggttcaatgacacttgcctgcagaaatcggccggtgagcggctgatgctgggcaatggcataacgctggctatcaaagccgccatcattaagttgaccatgaactgcacgaactttgagtttcattgaccacagttgtccagcacaaaccgcttgcggaagatattcgccatacagcacgaggcctggcgcagggaatatacgtcgaccttgtagatgagtaatttgaccgtaatgagtggtcataccgtcagtagcagtgatctcaacaattgcatcctgcgtcgcgccagttaaggtttctcctgcccacaaaatttgctttgctgctaatatgccccaaacgaaaaacagcaacgtcagcgcgatataacggacagttttaaaagggataaataccagtacgcaggcgaagacggtcagagacgcaagggttaatgtcccaggcaattggggcaaaatcagcaacggaaaaattccgcaaattatgcatacgccgactgtcgttattttcatgcacccctccctgtttatggaaagtgtgcaactttgttgagcggttgtctggtgggaattttgcgttccccgaggcacgttcagaagaatttaacgagagggtgaaaactgctcaaaactctgcgaggcagcttccagttccagattagagaaatgaaaaaagcacccgacaggtgcttttctcgcgttcaagtttgagtaaaaacttaaccgtaaatattggcgcgatcgcgcagttctttacctggtttaaagtgaggaacgtattttccttccagttctactttatcgccagtcttcggattacgtccggtacgtggtgcgcggtagtgcaaagagaaactgccgaaaccgcggatttcaatacgctcgccctgcgcaagagtcgaggccatatgctccagcatctcttttactgcatcttcaaccgtcttggcgggaatgtgcgattgctgggtggcaagtctttctatcaattctgacttggtcatgattcctccggttccttaaaggcaaattaagcggctgctgttgctgcattgattaagggcggccgtagccgcccttagtgcttgattacaggacgaaacctgcaatctgtcaagtaaactcaacaaacttcggaataaaaatcccgaagagtcagagaattactcgcctttagctgctttgaaagcttcagccattgcgttgttggagaagtttgcatcttcctgtttgttaacagttgcgattgcatctttctcgtcagcttcgtctttcgcacgaacagacaggctgattgcgcggtttttacgatcaacgccggtgaatttagcttcaacttcgtcgccaacgctcagaaccagggtagcgtcttcaacgcggtcacgggatgcttcagaagcacgcaggtaaccttcaacgccgtcagccagttctacggttgcgcctttagcgtcaactgcagttactttaccggttacgatagcgcctttcttgttcagagcaacccagttgttgaacggatcttctgcgagctgtttaacgcccagggagatacgttcacgttctgcgtcaacctgcagaacaactgcagcgatttcgtcgccttttttgtattcacgaactgcttcttcgcctgcaacgttccaggagatgtcagacaggtgaaccaggccgtcgatgccgccgtccaggccgatgaagataccgaagtcagtgatagacttgattttaccttcaacacggtcacccttgttgtgggtttccgcgaactgctgccacgggttagctttgcactgtttcagacccagggagatacgacgacgttcttcgtcgatatccagaaccataacttccactacatcgccaacgttaacaactttggacgggtggatgtttttgttggtccaatccatttcggaaacgtgtaccaggccttcaacgccttcttcgatttcaacgaagcagccgtagtcggtcaggttggtcacgcgaccagtcagtttggtaccttccggataacgtttagcgatagctacccacggatcttcgcccagctgtttcaggcccagggatacacgggtacgttcgcggtcgaacttcagcactttaacagtgatttcatcgccaacgttgacgatttcgctcggatgcttaacgcgtttccaggccatgtcagtgatgtgcagcaggccgtcaacgccgcccagatcaacgaatgcaccgtagtcagtgaggttcttaacgatacctttaacttccatgccttcctgcaggttttccagcagctgatcgcgctctgcgctgttttcggattcgataacggcacgacgagaaacaacaacgttgttgcgcttctgatccagcttgattactttgaattcaagctctttgccttccaggtgcagagtgtcacgcaccggacgaacgtctaccagagaacctggcaggaacgcacgaataccgttcagctcaacagtgaagccgcccttaactttgccgttgataacaccggtaacagtttcagcatcttcgtaagctttttccagcgtgatccaggcttcgtgacgtttagctttttcacgggacagcagagtttcaccgaagccgtcttctactgcgtccagagcaacgtcaacttcgtcacctacctggatttccagctcgccctgggcgtttttgaactgctcagccgggatggcggactcagatttcagaccagcgtcaaccagtactacgtctttgtcgatagcaacaacaacgccacgaacgatagaacccgggcgggtttcgatttcttttaaggactcttcaaagagttgagcaaaagattcagtcatgtttaatcttcaggtttatatttaacgtccacctggctccatgccggatggggttgtttaacatacccgctgtcattccattgcaacgggggtactgcaaattcggtcgcttatgcgagagccaatttctggcgcgcgtattgtagcgctttttcaatcacttgctcaatgcttaaggtggtggaatccaacactaaagcatcggctgccggaaccagtggcgctaccgctcggttacgatcgcggtcgtcgcgttctttgatctcggccaaaaggcgctcaaagttaacactaaagcccttctcctgcaactgtagcatgcggcgatgcgcacgttcttccgaggaggcgtcaaggaaaattttcactggcgcatcagggaataccaccgttcccatatcgcggccatcggcaatcaagcctggtaattcgcgaaacgcgcgttggcgacgcaataatgcttcacgaacgcgtgggaatgccgcgacttgtgaagcagcattcgccacttcctgagtacgaatttcgccgctgacatcttccccttcgaggatcacttccagattgccattggtcgacacaaaacgtacatccagatgggatgccagcggcaccagcgcatcttccgatgcaacatcaacatggtgatgtaatgccgccagtgccagtacgcgataaattgcacccgagtccagcagatgccattgcaacgcttccgccatagccttacacaaggtgcctttccctgcaccgcttgggccatcaatggtaataaccggggcaattgccgtcatctttatctccttaaaacaggcgtaccgttaacataaccgcgcgcattatacgcgccgacgccacaaatcgttaacgttgtgtgcaaaaaccagttttgtctgtattcagatggggatttattgcgcaattatagcgggctggcagaagaccagcccgaaagatgacaatgatttacttaccagaggcgatacgatcacggatgtgttgcgcacgctctgttgatggtgggtgagagtcaaacatggactgggtacgaccgccatccaggctggccaatttttcaaagctgccaaccagcccctgggtgctgatgccacgtttcttcaacagatcaaaggagaaatcatctgcttcggactctttatcgcgggagtatttagcattgatcgcgccttctgcgatatcacctaattgtgagcgagaaagctgggaagccacaccgctggtagcggaaatcgcatcacgtgcggcaacgatcgcataagaagctttcatttcagccagcgagtgacccaacgcgacgtggcccagttcatgacccagaacgccttcaatttcgttgtcgttcatcatgtccatcaggccactgtagacacgaacacagccgttcgccatcgcccatgcgttgacgtcgctggtcatataaaccttatagttgaccggcgtgccattaatattgttacccaatgctttggcgatttttgccagacgtttaccgtacttgctggatttacttgcgacttgattgccgctgtccatttcggcacagccctgattggcgattgctttagcatcagcatcgcttaatgttgcggctttataagcattcagacctgagctgatagccaaatcggtattaataccgtgcgtattctgacatcctgtcagtaaggctgcagaggtcgcaatcgccagcaataatttagtattcttcatgtgaatcatccgttgattaattatatataaacattatgtatcaacaagttacattgataattaacgctaccattaataaaaataccccacaaggtccgaaaaaaaacgccggcaatgtgccgacgtctttgaaaagaaaggattgtctatgttatcgcccgttattcattcagccgggttgacttatccgcgccaattgctcgaaatagtctggaaaagttttagcggtacattttggatcaagaatcgtcacagccgtatctgataatgcgaccagcgagaaacacatcgccatccggtgatcattgtatgttgcgatctcggcaaagttcagtttttccggtggagtgatacgaatgtaatcgtgcccctcttctacttccgcaccaactttacgcagttctgttgccatcgcaaacaggcgatcggtctctttaacacgccagttatagatattgcgcagcgtggtggtgccttttgcaaataacgccgccgtggcaatggtcatcgccgcatcaggaatatggttcatatccatatcaatagcgttcagttcaccccgcgtgcaggaaatataatcatcgccccagcaaatggtcgcgcccattttttccagcacatcagcaaagcgaatatcaccctgcatactgttgcgtccaatgccggtcacttttacagtaccgcctttgattgctgctgctgccaggaagtaagaagcggaagatgcatcgccttcgaccaaataagtacccggagactgataagactgcccgcctttaacgacaaattgttgatagtgctgattttcaatttcaacaccaaacgtcttcatcagattgagtgtgatgtcgatgtaaggtttagaaaccagatcgcctttaatacgaatcaccgtatcttccggcgcaagaggcgcagtcattaacagtgcggtgaggaactggctggaaacggagccatcaacttcaacgttgccgccagtaaagccgccctgtaaacgcaatggtggataattttcttgttccaggtaagtgatcttcgccccgcccaggcgcagcgcatccaccagatgaccaatggggcgttctttcatacgcggttcaccggtcagcacaatatcattgctacccagacaaagagctgccgccagcggacgcattgccgttccggcgttaccgaggaacaactccagggcaccttctgcgtgtaatggaccgccgttaccgatgatttcgcaacgcgtacgatcagctgaaagcgtatagcttacccctaacgctgctaatgcattcagcatatggcgcacgtcatcgctatccagcagattggttaatactgttttgccgtgtgctaatgccgccagcaataaagcgcggttagaaacgctcttggaaccgggcagattaatagtgccatcgacacgagcgatgggttgtaacgtcagggattccatgaactcaactctctacaacagaaataaaaaccccacaggctggctgtggggattaagcaaaatttcggcattagccgtgacggcgttcgaactcaatcatgaagtctgtcagcgctttaacgccttccagcggcatggcgttataaatagacgcgcgcattccgccgaccacacggtgacctttcagcgcatgaaggccagcagcaaaagactcttcaaggaacaatttgtcaagcgcactgtccgccaactggaacggcacgttcatccgcgaacggttagctttcgccacgtcattgcggtagaaatcgctgttatcaatcaccccatacagcagttctgctttttgctgattgattttatccatttcagctacaccgccgttcgctttcagccatttaaagaccagaccagacagataccaggcaaatgtcggcggcgtgttaaacatggagccgttatcgttgaggatggaataatccagaatcgacggacacgcgatattcgctttgcccagcaaatcttcacgaacgatgacgattgtcaggcctgccgggccgatatttttctgcgcgccagcgtaaatcacgccataacggctgacgtcaatcggacgggaaagaatggttgaagagaagtcggcggcgaccaccacatctttgccgaagtctggcgtttcgtcgatagcgataccgtcgatggtttcattcgggcagtaatgcatataagcagcattatcagagagttgccattcgcgcattggcttaaccgcgcgcagaccatcaacagtcactttggcgtcgaagacattaggcgtgcaatattttttcgcttctttaatggcacttgccgcccagtaaccggcatcaacataatctgcggtggttttatcaccgagaatattcagcggaacagcagcaaactgaccgcgaccgccgccatggcagaacaataccttgtagttggaggggacattaagaagatcgcgaaaatccttctcggcttcctctgcaacctgaatgaactctttgccacggtgactcacttccatcaccgacgtaccaagaccgttccagtcgcgcagttcctgttgagcctgtttaagcacctctgccggtagcattgccggaccagaactaaaattgaagatttgagccatttcccctcaccacgttgcgttgctattaacctgcggtcaatcgattgcgaccacaggtaatacattattcctgtggctatcggttttatcattcagtgacacacatcgcaatgagtaaaaccgttgagggcaaaaatgtggcttgcatcacacaaaagaatctctcggattattagcaaaaagccgatgtttttactgtcacgtcacccgttttgcccgacttgccttcgtccattctggatttgcacagcgcggacataattgtttttcccccgcgttcatatgaatgatttcactgcaacgaatgcaggcatagtccgccgactcgggtaccactttgtaacgctgagtacagtcactgggtaaaataagtaagcccggtttcaccttgtcatcttcaaagaaatagacactgatttgcccgttggtttcgagaatcgccagacgtacttgccccaactgctctacaccgcgcaatcgtagctccataaagaactcaaattccgtcatgttggagttattgagtttcgaccaggccagctcgccatcttcaataatgacaaccggcttaccttccagaagatcttccagtttttcactgtgtgccatcaaccacattaccaggcggtataacaacgccagagtaataaagacgataagtaccgggaccatcggcacatcatcataaaacgccacatctcccgccgctgatcccagcgtcagaatgattaacacttcaaaaagcgacatctgccgcacaccgcgtcttccggtcattttgaggaacaaaaaaaccagtacaaaggtataaagactacgtagtgccacttcgccaaggaaatcaaaaggcactttatcaaatgccatacggtggagatcaaacgccttcatttttatgctcttatcgtggtttatccactaaaagcatagtcaacagttcatcggcatggcggcggtgatagcgcctttgagataaaacccgtattattgcgcgctttccgtacgactaaagtgattttcatgacgcaaacatttatccccggcaaagatgccgcactggaagattccatcgctcgcttccagcaaaaactttcagacctcggctttcagattgaagaggcctcctggctgaatccggtgcctaacgtctggtctgtacatattcgcgacaaagagtgcgcactgtgttttaccaacggtaaaggcgcaaccaaaaaagcggcgctggcttctgcactcggtgaatatttcgagcgtctctcaaccaactacttttttgctgatttctggctgggcgaaaccatcgccaacggtccgttcgtgcattatcccaacgaaaaatggttcccactgagcgaaaatgacgatgtgccagaagggctgctcgatgaccgtctgcgcgcattttacgatccggagaatgaactggccggcagtatgctgattgacctgcaatccggtaacgaagatcgtggtatttgcggtctgccgtttacgcgccagtccgacaatcagaccgtttatattccgatgaatatcattggtaacctgtacgtttctaacggtatgtccgctggcaatacccgcaacgaagcacgcgttcaggggttgtccgaagttttcgaacgctacgtgaaaaaccgcattattgctgaaagcatcagcttgccggaaatcccggcagacgtgctggcgcgttacccagcggtggttgaagccatcgaaacgctggaagcagaaggtttcccaatctttgcttatgatggttcgcttggcggccagtatccggtgatttgcgtggtactgttcaatcctgctaacggcacctgctttgcctctttcggtgcacatcctgattttggcgtagcactggaacgtaccgtgaccgagctgctgcaaggtcgtggcctgaaagatttggatgtgtttactccgccaaccttcgatgatgaagaagttgctgaacataccaacctcgaaacgcactttatcgattccagcggtttaatctcctgggatctgttcaagcaggatgccgattatccgtttgtggactggaatttctccggcactacggaagaagagtttgctacgctgatggctatcttcaacaaagaagataaagaagtttatattgccgattacgagcatctgggcgtttatgcatgcagaattatcgtacctggcatgtccgatatttatccggctgaagatctgtggctggcgaataacagtatgggcagccatttacgtgaaacgattctttcgttaccaggcagcgagtgggaaaaagaagattacctgaacctcatcgagcaactggatgaagaaggttttgatgactttacccgcgtgcgtgagctgttgggtctggcgaccgggtcggataacggttggtacaccctgcgtatcggtgaattaaaagccatgctggcgctggctggtggcgatctggaacaggctctggtctggaccgaatggacgatggagtttaactcatcggtattcagcccggaacgcgccaactattatcgctgcctgcaaacgttgttattactggcgcaggaagaagatcgccagccgctgcaatatctgaatgcgtttgttcgcatgtacggcgcagatgccgtggaagccgccagtgcggcaatgagcggcgaagcggcgttttatggtttgcaaccagtagatagcgatctgcacgcgtttgctgcacatcagtcgttgttgaaggcctacgaaaagctgcagcgcgccaaagcagcattctgggcaaaataaaatcaaatagcctacgcaatgtaggcttaatgattcgtctgagttatattacggggcgtttttttaatgccccgctttacatatatttgcattaataaaataattgtaattataaagttaaatatcggtaatttgtatttaataaatacgatcgatattgttactttattcgcctgatgctcccttttaattaactgttttagcggaggatgcggaaaaaattcaactcatttgttaatttttaaaatttatttttatttggataatcaaatatttactccgtatttgcataaaaaccatgcgagttacgggcctataagccaggcgagatatgatctatatcaatttctcatctataatgctttgttagtatctcgtcgccgacttaataaagagagagttagtgtgaaagctgacaacccttttgatcttttacttcctgcagcaatggccaaagtggccgaagaggcaggtgtctataaagcaacgaaacatccgcttaagactttctatctggcgattaccgccggtgttttcatctcaatcgcattcgtcttctatatcacagcaaccactggcacaggaacaatgcccttcggcatggcaaaactggttggcggtatttgcttctctctggggctgattctttgtgttgtctgcggagccgatctctttacttccacagtgttgattgttgttgctaaggcgagtgggcgcatcacctggggtcagttggcgaaaaactggctaaatgtctattttggcaacctggtcggcgcactgctgtttgtacttttaatgtggctttccggcgagtatatgaccgcgaatggtcaatggggactcaacgtcctacaaaccgccgaccacaaagtgcaccatacttttattgaggccgtctgtcttggtatcctggcaaacctgatggtatgtctggcagtatggatgagttattctggccgcagcctgatggacaaagcgttcattatggtgctgccggtcgcgatgtttgttgccagcggttttgagcacagtatcgcaaacatgtttatgatcccgatgggtattgtaatccgcgacttcgcatctccggaattctggaccgctgtcggttctgcaccggaaaatttttctcacctgaccgtaatgaacttcatcactgataacctgattccggttacgatcggtaatattatcggcggtggtttgttggttgggttgacatactgggtcatttacctgcgtgaaaacgatcaccattaatggttgtcgaagtacgcagtaaataaaaaatccacttaagaaggtaggtgttacatgtccgagcttaatgaaaagttagccacagcctgggaaggttttaccaaaggtgactggcagaatgaagtaaacgtccgtgacttcattcagaaaaactacactccgtacgagggtgacgagtccttcctggctggcgctactgaagcgaccaccaccctgtgggacaaagtaatggaaggcgttaaactggaaaaccgcactcacgcgccagttgactttgacaccgctgttgcttccaccatcacctctcacgacgctggctacatcaacaaagcgttggaaaaagttgttggtctgcagactgaagctccgctgaaacgtgctcttatcccgttcggtggtatcaaaatgatcgaaggttcctgcaaagcgtacaaccgcgaactggacccgatgatcaaaaaaatcttcactgaataccgtaaaactcacaaccagggcgtgttcgacgtttacactccggacatcctgcgttgccgtaaatccggtgttctgaccggtctgccagatgcttatggccgtggtcgtatcatcggtgactaccgtcgcgttgcgctgtacggtatcgactacctgatgaaagacaaacttgcacagttcacctctctgcaggctgatctggaaaacggcgtaaacctggaacagactatccgtctgcgcgaagaaatcgctgaacagcaccgcgctctgggtcagatgaaagaaatggctgcgaaatacggctacgacatctctggtccggctaccaacgctcaggaagctatccagtggacttacttcggctacctggctgctgttaagtctcagaacggtgctgcaatgtccttcggtcgtacctccaccttcctggatgtgtacatcgaacgtgacctgaaagctggcaagatcaccgaacaagaagcgcaggaaatggttgaccacctggtcatgaaactgcgtatggttcgcttcctgcgtactccggaatacgatgaactgttctctggcgacccgatctgggcaaccgaatctatcggtggtatgggcctcgacggtcgtaccctggttaccaaaaacagcttccgtttcctgaacaccctgtacaccatgggtccgtctccggaaccgaacatgaccattctgtggtccgaaaaactgccgctgaacttcaagaaattcgctgctaaagtgtccatcgacacctcttctctgcagtatgagaacgatgacctgatgcgtccggacttcaacaacgatgactacgctatcgcttgctgcgtaagcccgatgatcgttggtaaacaaatgcagttcttcggtgcgcgtgcaaacctggcgaaaaccatgctgtacgcaatcaacggcggcgttgacgaaaaactgaaaatgcaggttggtccgaagtctgaaccgatcaaaggcgatctcctgaactacgatgaagtgatggagcgcatggatcacttcatggactggctggctaaacagtacatcactgcactgaacatcatccactacatgcacgacaagtacagctacgaagcctctctgatggcgctgcacgaccgtgacgttatccgcaccatggcgtgtggtatcgctggtctgtccgttgctgctgactccctgtctgcaatcaaatatgcgaaagttaaaccgattcgtgacgaagacggtctggctatcgacttcgaaatcgaaggcgaatacccgcagtttggtaacaacgatccgcgtgtagatgacctggctgttgacctggtagaacgtttcatgaagaaaattcagaaactgcacacctaccgtgacgctatcccgactcagtctgttctgaccatcacttctaacgttgtgtatggtaagaaaactggtaacaccccagacggtcgtcgtgctggcgcgccgttcggaccgggtgctaacccgatgcacggtcgtgaccagaaaggtgcagtagcctctctgacttccgttgctaaactgccgtttgcttacgctaaagatggtatctcctacaccttctctatcgttccgaacgcactgggtaaagacgacgaagttcgtaagaccaacctggctggtctgatggatggttacttccaccacgaagcatccatcgaaggtggtcagcacctgaacgttaacgtgatgaaccgtgaaatgctgctcgacgcgatggaaaacccggaaaaatatccgcagctgaccatccgtgtatctggctacgcagtacgtttcaactcgctgactaaagaacagcagcaggacgttattactcgtaccttcactcaatctatgtaattagatttgactgaaatcgtacagtaaaaagcgtacaataaaggctccacgaaagtggggccttttttagcacgagagccttttttgtcagctatctatactttaaggtgactgccaaaacagactcgacgtagccttcgagctgcgcaccaacacggcctcagatgggccacatctggagaaacaccgcaatgtcagttattggtcgcattcactcctttgaatcctgtggaaccgtagacggcccgggtattcgctttatcacctttttccagggctgcctgatgcgctgcctgtattgtcataaccgcgacacctgggacacgcatggcggtaaagaagttaccgttgaagatttgatgaaggaagtggtgacctatcgccactttatgaacgcttccggcggcggcgttaccgcatccggcggtgaagcaatcctgcaagctgagtttgttcgtgactggttccgcgcctgcaaaaaagaaggcattcatacctgtctggataccaacggttttgttcgtcgttacgatccggtgattgatgaactgctggaagtaaccgacctggtaatgctcgatctcaaacagatgaacgacgagatccaccaaaatctggttggagtttccaaccaccgcacgctggagttcgccaaatatctggcgaacaaaaatgtgaaggtgtggatccgctacgttgttgtcccaggctggtctgacgatgacgattcagcgcatcgcctcggtgaatttacccgtgatatgggcaacgttgagaaaatcgagcttctcccctaccacgaacttggcaaacacaaatgggtggcgatgggtgaagaatacaaacttgatggtgttaaaccaccgaagaaagagaccatggaacgcgtgaaaggcattcttgagcagtacggtcataaggtaatgttctaatttccccgtaaagcggcaacttttttgagttgccgcttttttattccgctctgcataaataattcagagctctatttctaacgcccttacagcacagcttccaaatgtattacccaaaccgccagtatatgtcctgcggcttacgcgcatttctcgattatgtaaaaacgggtcagatctgccagagtcagcgtcaccgaccacaataattatttatcattcgctttacgcgccagcagcgggaatatcagtcctaatcctaccaacacaaacggcgttgcaacattcagcgccaactggaaggtccactctgcagtgaaggcttccattttcgggaagatccccgtcaaacaggcaaaggcggtaaaggcaaaacaccaaatcccgacggtcattgccagaggcttattacgaataaagacatattctggtttatatttctgcgccaggcgaacgactgcaataaatgcaacaaatacccataaataacgcagcggcatcactaccgagttaagattcaacagccatttatagagattgttcatatcaccaatgccgagagtcggtagcattatcaggatcgccaccagcaccagggtcagaaaatagccattaacgggcgtaccagaagcgttggtacgacataaactggctggaatatatttgctgtcagcatcgcctaataacactttaagcggcgcatcaatcgagaataccagcgcagctacttgtcccagggtattcgcaatggcataaatcaccattaaagtattacccatgttgtaatactcgcccagcttctgaaaggcgtaatactgaccgttagtcattaagtcatccgggatattacgcgagtcaaacatcatccccatcgccagtgagcccagaatggcacaaaccgcaaccatcaccgccaggcataacatcccttttggaaattcttttcctgggttgcgcgtttgattaacgtaaggagaaatcttctctgctccgccaaccgcgaaaaccagcattgaaatagtggtaatgtaggtaaagtcgatatgaggaatgaacgtttcccaggtaatgtttgtggtcgcaatatgcacttcagtaattgcaggcgcggttaccgccatcgccacatacaggagcgacataacaaacatcgcaatccctgccacagaaccgacgattttcagcgatttcataccgcgtgaagcaacccacataaagaagataaacagcaccagcgttaacccctgtaacgctacgactgaatattctttgattaacgaaccgtcgcctttcatcgcccaaccgagcgcaatcagtattgcctggggtttttgtgccagatagggaatatgcactacccagtaggtccacgcggcgaggtaagccagtccgggtcccatcgtgtgtttaatccaggtactgaccccgcccttcccatctttgaaggtcgagcctaactgaccaacaattagcgcataaggtgtgaaatagagcgcaaagataaacacccatgaaaaaacaaccaccagcccctggttggcgtagttattaacaacgttgccaaaaccccagacagtgataaaagacatcagcgcaatgttgtaccatcgcagctgtttttcctgaacattcccagccatagacaaatccttcgccaaaattaaaggggcatctgtaaaacgagggattatgcgcggcaaataagaagtgcggaaatagcgaaatgcaaaattataacctgctgcacattttatttttaaacgaataaaatttggaataaagcaagtcagatagaagaaacaaaaaagcagagtgtgaaacagtaagttcacactctgcttgaattcatttacacgtgagcaacgggtttcggcgtatgaccggcgttgcgaagcagcatcagcaaatagataaacgatacgctggcgatcatgataaacaataaattatcggagaaattctgcattagcatagcggtaaatgacgggccaagcagacttcccacggtatagctcaacagtaaggcctggttcatcgccaccagttgatgatgttcaactttctcgcaagcccaggccatcgccaccggatatagcgtaaagccagcggcaccgaggatgaataacgctggggccatcgccgcctggctaagcatcgcgatactgccgagaatgacgacaaagacctgaacacgcaacaccagcagtcgaccaaacttatccgccagacgtccaatcggccattgtccaaggatacccgcactgaccagtaccgccatccagaaaccaatgctggcattgctcacccctttgtgattgaggaacagcggcatcaggccatatagagatcccagaacgattcctgagataatgcagccattcacgccaagccgcgcctgacggagttttagcattgacgtaattgacgtcgaatcatggttttcagcctgctgattcagcacacgcgtaaacaacagcggtaagatccctgccaacgtcaaacctgtaacccacggcaatacggacatcagctcggttgaaactttgctgaccagtaactggcctaaaaacgttcccacgtaataaaccatcatatacgcagcaagcaaacgcccacggttacgtgacgtcccactgcacatcagcgcgctctcaacaaccacccaaatcatggcacagccgacgccggcgacaaaacgccaagtcaaccagctccagaatccaatcatcaggccaaggccggcacagccagcggcaaaaatgaaggaggccagataatagctgcggttaaagccaatgcgcttaatgacataccctgtcagcaatgtaccgaccaggttgccggtaaaataggatgagctgacaacgcctacctgccatgtggacatatgttcctgggcgagccaaagcggcacgagtgtatttaacactgcgatcgccagagtcaacaaaagcaggccagacagcaaaagcatgacaggccgggtatacgtggacatgaattaaaaccgtgaggaagttcaaatttcatgcgcatcatgccaccgccaaaaacattgtcaatgggtgaaaatacgcgcatatcgcagctgaggtattatcgatttatattactcattcataacgctaatgctggagagacgattaatctcatctgattgtttttattgatctaacacaaatttcatacgcttcgttcagtcgaaaaatttcatggtcacagcaaactcatatttcccgtctatgctttcagagcaatgcatcgcgtctgaccgatttcagacgtaccactgactctcgaaaggagaagaggatgaccaaaccgtatgttcgtcttgataaaaatgatgctgccgttttgcttgttgatcaccaggctggtttactttcccttgtacgggatatcgaacccgataagtttaaaaataacgtgctggcgctgggcgacctggctaagtatttcaacttacctactattcttaccaccagttttgaaaccggtcctaacggcccattagttccagaactgaaagcacagttccccgatgcaccttacattgctcgcccgggcaatattaacgcctgggataacgaagattttgtaaaagctgtcaaagcgacaggtaaaaaacagttaattattgccggtgtggtaaccgaagtttgcgtggcattcccggcgctttcagccattgaagaggggtttgatgtatttgtcgtgactgatgcatcagggacctttaatgaaattacccggcattcggcgtgggatcgcatgtcgcaagctggtgcgcaattgatgacatggttcggcgtggcttgcgagctgcaccgtgactggcgtaatgatattgaaggactggcgacgttgttctctaaccacattcctgattatcgtaatttgatgaccagttatgacacattaacgaagcagaaataaaagagaaccggggtcgaaaccccggttgttactgattagcttgcgacggccatccccacggtcatatgcaaaccatagaatacgccgcggccgattaattctcctgccagaagcagaatgaatgagacggatagtagcggaaccgcaggctgataaccttttagctgtggtgcaatccacaaacacagggcaacagccaaaagcacgatccgccaggacatcagcgcaccatagtccggcaccagcgctgcggcctgctgcacagaactatgaatagtcgccagctctgcgccctgcatcactgacatcacaccactcactaccagtgccagtacagaaatggctggcagcagacgcatcgcccagccatcgacgccagccagactcagcaacaggtaacccagtaacgggccgcccataaacatcgtcaggaagaagcccatcggcgtccagatgctgtaccaggtcggaacggtatgaatgctgttatacacacgcaccatcatccagacaaagatgacgccaagaaccatcgtcactatcagccacagcgtacgcaatgccggtgacagctttttcagcattgccagcaaccagccgatgccaccaacagcaaaaaagatcgaaccgctggcgatttcgttactgagtgctgaagcccctacccggttgagcgagttaaaggcgcgcatcggtgaaccaagatgaagcatagaggcgataaagccaatgcccatcagcacccataaaccaaacatgcaggcaataacacgctgctgggcttctgctcgcaggtcgcctttgagcagcgccaaagccagaacgataaaaccacccgctacacattgcccgaagaccgtgaagatcatcagcggccattcatgccatccacttcccatctcacacctccttcgggtttgccagatagccagtggtatccccggtcgggcggctgttggcattgggtttgatcacaatattcggtttggtaaagtgagctcgcggcaacggcgcaacggccgccagatcgccatgttttttacgcagctcgtcgatagggccgaaatccagcgcccgcagcgggcaagattcaacacagatcggctttttcccctccgcaacacggtcataacaaccatcgcatttggtcatatggcctttcgtttcgttatattgcggtgcgccatacgggcaagccatatggcagtagcggcagccaatgcacacatcttcatcgactacaacaaaaccatcttcacgtttatgcatcgcaccactcgggcagactttagtacaagccggatcttcgcagtggttacatgaaatcgacagatagtaggcaaacacgttctgatgccagacaccgttatcttcctgccagtcaccgccagcatattcataaatgcggcggaagctgacttccggcgtcagatctttatagtctttacaggccagctcgcaggttttgcaaccggtgcaacggctggaatcaataaaaaatccatactgggttgtcatcggttactccttacaccttttcaacctgaacaaggtttgtatgtgacggattccccttagcgagaggagacggacgttgagtggtcagtacgttgatacaaccgcccttatcgacacgttttgcatccgggtcataccaggcaccttcacccagtgcgaccacacccggcatcattcgtggcgtcactttcgcctcaatatgaacctcaccacgatcgttaaagatcctgactttatcgccgttgttgataccgcgtttttgggcatcaagcgggttgatccacatttcctgacggcaagccgctttcagcacatcaacgttgccgtaagttgagtgaacgcgagatttatagtggaaacccgtaagctgcagcggatactgtttgttcagcggatcctgataactttcaaagcccggcgtgtagatcggcagtggatcgatcacatcgccttctggcaattcccaggtagcggcaatgtcagccagcgcctgcgaataaatctcaattttacccgatggcgtggtcagtggatttgcctgcggatcttcacggaaggctttataagcaacgtgatgcccttgtgggtcgcgctttttaaagatcccctgcttgcggaactcttcaaacgttggcagttcaggaatcgcttcccgcgactgggcatacagatgctgcatccactcttcctgggtacggccttcagtaaactgttgctcaacgccaagacgttttgccagttcgctggtcatttcatagatggtcttacattcaaagcgcggtttaatcacctgatcgttgaaaatcacgtaagacatattcccgcaggatgcatccagtgcaaagtccatctgttcggaagcggtgcagtcaggcagcaggatgtcagcatatttcgccgatgaggtcatgtggcagtcgataaccacaatcagctcgcacttcttatcatcctgaaggatttcatgggtacggttgatttcagaatgctggttaatcaggcagttaccagcatagttccagatcattttgatcggcacatccagcttatctttcccgcgcacaccatcacgcagcgccgtcatttccgggccacgttcaatggcatcggtccacataaacatcgaaatgctggtctggatcgggttttcgagggtcggcatacggacaaacggtaagctgtatgaaccttcacgcgcgccgctgttccccccgttaataccaacgttaccggtcagaatcgccagcatcgagatagcacgggttgcgatttcaccgttagcgtgacgctgcgggccccatccctggctgataaacgccggtttggtactaccgatttcacgagccagtttgatgattttgtctgccggaacaccggtgatttgcgaggcccattccggcgttttagccacgccatctggcccttcacccagaatataagctttatagtgaccatttttcggcgcactggctggcagtgttttctcgtcgtagccaacgcaatatttatcgaggaatgcctgatccaccaggttttcggtgatcatgacatacgccagaccgttaaccagtgcggcatctgttcccggacgaatagggatccactcatcttcgcgcccggctccggtgtcggtatagcgcggatcgatgatgatcatgcgagcattagatttctgacgcgcctgttcaagatagtaagtcaccccaccgccactcattcgcgtttcgccagggttattaccaaacagcactaccagtttactgttttcgatatccgacgggctgttaccatctgcccagccgccgtaggtatagttcaaaccttccgcaatttgcgcggaagagtagtcaccgtaatggttcagataaccgccgcagcagttcatcaggcgagcgaccagggtatttcccggcggccaggagcgggtcatggtgccacccagcgtaccggtgccatagttcagatagatggattcgttgccgtactctttgatcaggcgctgcatattggtcgcgatgatgtcgtaggcttcttcccagctaatgcgctcgaatttgccttcaccgcgcgccccgactcgtttcatcggatatttcaggcggtccggattgtagacacggcgacgcatggaacgaccacgcagacaggcgcgcacctggtgcaggccgtcatagttgtcatcgccagtattatccgtttcaacatatttgatttcaccgtccacgacgtgcatacgtagcgggcagcgactaccacagttaactgtacaggcgctccagataaccttttcgtctgattttgttggaatggcgctatcgacagcgtgcgcaatccgactaaaaggtaatgttaatgcgctgctggccattgccaggccgccgatcgctgtcgtttttaccaaaccacggcgactcacctcagcagccaataccgcatcagggattttcgttttcataatggctcactcaagcttgctcacgattgattccagtaacaaaccgtattgtgtaattatttctatagcaggtcgctatataggcttgtatacatcgaataatttgaaaatcaaagagataggtagattttcactcgaaagtagtattacgtgtaagtgaggagtaattattgttcggtatcaaagggagacaaaaaaagcgcccgcaggcgctttttagattcagaaaaattgggtattagccaatatattccagtccgttcatatacggacgcagaacttctggtacttcaatacgaccatcagcctgctgatagttttccataaccgcaaccagcgtacgaccaacagccagaccagaaccgttcagggtatgaaccagacgggttttcttgtccgacttgctacggcaacgtgcctgcatacgacgcgcctggaaatcccagacgttggagcaggaagagatctcgcggtaggtgttctgtgccgggatccatacttccaggtcgtaagttttgcaagcaccaaaacccatgtcgccagtgcaaaggatgattttacggtacggcaggcccagcaactgcaggactttttctgcatgaccagtcatctcttccagcgccgccattgagtcttccggtcgcacgatctgcaccatttcaactttgtcgaactggtgcatacggatcagaccacgggtgtcacgaccatatgaaccggcttcagaacggaagcatggggtgtgggcggtcatcttaattggcagatcatcttcatcgatgatttcaccgcgcaccaggttggtcagcggaacttctgccgttgggatcagcgcatagttactggtgtctgcttcttcttccagcggacgagtatggaacagatcgccagcaaatttcggcagctgacccgtaccgtacagcgtgtcctggttaaccaggtacggaacatagttctcactgtagccatgctgttcggtatgcagatccagcataaactgcgacagtgcgcggtgcatgcgagcaatctgccctttcattaccacaaagcgggaaccggtcaacttaactgcggctgcaaagtcgaggccagagtgcatttcacccagcgtcacatggtcacgaacttcaaagtcaaactcacgcggggtgccccagcggctgacttcaacgttgtcattttcgtctttacctactggcacttcatctgcaggcaggttagggatggttagcgcgatatcgcgaatttcagcctgtaaagcatccagctcggcttttgctgcatccagctcttcgcccagtttgttcacttccagacgtaaaggctcgatatcttccccgcgcgctttcgcctggccaatggatttcgatcgggagttacgctccgcttgcaggttttccgttttgacctgcaatactttacgacgctcttcaagagcgcccagcttatctacatccagcttaaagccccggcgtgccagtttttcagcgactgcgtctggctcattacgcagcagattgggatcgagcatgcttatcctgtgcttatcgaattaaatgggagatgtggccacagcctgcgaccacagggatacagtaacaacattaccgcaacgataacattaacggtagcgttttatggggctattttgatcctgttcagccagccaggcgagcttttcgccaatcttgccttcaaggcccctgtttgtcgggaaataatagcgtgtttgtgctatttccggcgggaaataaacctcaccggcagcataagcgtttgcttcatcatgagcgtaacgatattcctgcccgtagcccatttccttcattaatttcgtcggcgcattacgcaaatgaaccggcacgtcataatccggacgttcgcgagcatccgccagcgcggctttaaacgcagtgtagacagcgttgctttttggcgcgcaggccaggtaaacaatcgcctgagcaatggcgcgttcaccttccgccgggccaactcgggtaaagcaatcccaggccgcaattgccacctgcatcgctcgtggatcagcattacccacatcttccgacgctatcgccagacagcgacgcgcgacatataacggatcgccaccggcagtaataattcgtgcataccagtacagcgccgcatcgggtgcgctaccacgtaccgacttatgcagtgcggaaatgagatcgtaaaagcgatcgcctttgttatcaaagcgggcgctacgttcaccggcgatttcggtcagtaattcaggcttcaggacccgcttaccgctatcatcgacttcggccatatccgccatcatttccagcgtatttaacgcccggcgcgcgtcgccattcaccagttcagcaatggcgcgtcgtgtttcatctggcagaacaatatcctgaccaccatagccacgggttttgtcttccatcgcctgagtcagtacttgctcaatatcctctgtactcagggatttcagcagatagacacgggcacgggaaagcagtgccgaattaagctcaaatgacgggttttcagtggttgcaccaataaaagtgatggtgccgtcttcaatatgtggcagaaacgcatcctgctggcttttgttgaaacggtgaacttcgtcaacaaaaagaatagtgcggcgaccagcattgcggttttgccgagcgcgctcgatcgcctcgcgaatctctttcacgccagaagtaacggcagaaatacgttccacatcagcgttcgcatagcgggcaatcacttcagcgagggttgttttgccggtacccggtggcccccagaggatcatcgaatgcaaatgcccggcttcgattgcacgcggcaacggcttccccgcagccagcaaatgttgctgaccgatatactgtgctaaattttctggccgcatacgcgcggccagaggttgaaaagtgttatccgaaaaatcgagcgacagattgctcactcaggtgcctctacttacgttgatcatctaccgtgacgccttgcggcggggtgaaggtaaatttcgctgcatccacagccccattttgctgggatttcagctgataactgctgcgctgatcgtcctgctccaccgcgctaaactgatggatcgtgccatcacgtcccacgttaatggtgaactgcttcagattgccattgctggctttcggcgtcaggacaaagtcatcgccattctgtttgatattgtactgctgccagtcgctggactggttgcgggcaatcagcataaacggcgtattaccggtggcatctttcagccaggttgccgtagcttgctcaacgaacgggttatagaaccacagtgttttaccgtcagaaaccagaatgctttcatcaggttgagtcatatgccagttgaataagtttggacgtttcacccacagatcgccctggccttcctgcaccgccgcgccgctaccgtcagtcactttttgtgtgaagctggcgtggaagctgctgactttatccaggcggcttttcagatcgcttgcggcatcagcccaaacgctgcttgctactaagcttgagagtaatgcacaggtgatggcaatttttttcatcattattcctcaaattacgtcactcccgaccgggagttccctctactctctattccaggctaataatcagcttgaggaaagaagaaaatactgaattttcagttgatagagtgccggatgcaacgctaccgcgccttatccggcctacgatgcattaattagtcaaacggcggtggggccagcacttcacgattaccgttgtgcccctgttcgctgacaatcccctgcgcttccatctgttcgataatacgcgctgcacggttataaccaatgcggaactgacgctgtacgccagaaattgatgctttgcgtttttcagtgacaaactgcaccgcctgatcgaacaacggatccagttcttcagcgccatcgaaaccgcccgcgccaccttcgctttcactgtcggaggtgatgccatcaacatactgtgggcgaccacgcgctttccagtcctgcaccacggcatgaacttcctgatcgcgaacaaaagcaccatgaacacgtaccggcaacgtggagttcggcccagagtaaagcatatcccccatacccagcagtgattccgcgccagcctgatcaagaatggtacgtgagtcaatcttactggatacggtaaaggcgatacgggtcggaatattcgctttaatcagaccagtaataacatcaaccgatggacgctgcgttgccagtacgaggtggatacccgcggcacgggctttttgcgccagacgtgctataagctcttccacttttttacctaccgtcatcatcaggtcggcaaattcgtccaccaacaccacaatgtacggttcttttttcagcaccggatgctgggcatccatactgtcacccggcttccagtacgggtctggaatcggacgcatcatgcgatcggcttcagcaattttttcgttataacccgccagattacgcacacctagggcggacatcagcttataacgacgttccatttcatttacgcaccagcgcaaagcgttggcagcatctttcatgtcggtaacgacttccgttaacagatgcggaatgccttcataaaccgaaagctccagcattttcgggtcgatcatgatgaaacgcacatcttctggctgtgctttataaagcatgctcaggatcatcgcgttcaccccgacagacttaccggaaccggtagtccccgcaaccaacaagtgcggcattttcgccagatcggcaaccaccggctcaccggcgatatctttacccagcaccacggttaatggcgacggattatcgcggaatttggcgttatccaatacttcgcgcagataaacggtttgtcgttttttattcggtaactccagacctacatagggtttgccaggaataacttcaacgacacgcaccgccaccgtcgaaagtgaacgggcaaggtcccgtgacaagttagaaatgcgcgccgcttttacgcccggtgccaggttaagttcaaagcgagtgataaccggccccggagagtaattgacgacatcggctttaatacggaaatcagccagacgcgcttccaccaggcgcgccatttgttcaagcgcaaaggtatctaccggctccacttcgctcggcggcggcgtcagcaaatccagagaaggcagcggcgtcgtcggtttatgcaacggacggctgtcaccattgcgcatcaacagcggatgaagcagggtatcctgcggctgtggcgcaactggctgttgtggctgctgatactgcggctgcggtgcaaccggttgttgcagctgttgatactgctgctgcggcgcaaccggctgttgcggctgctgatattgctgctgtggcgcaaccggttgttgcggctgctgatattgtggctgcggcgcaacctgctgttgtggctgctgatactgctgctgcggcgcaaccggctgttgcggctgctgatattgctgctgtggcgcaaccggctgttgtggctgctgatactgctgctgcggtgcaaccggttgttgcggctgctgtacaggttcaacaattggcgtaaacaacggttcgtgtggaccatcatccagcaacgctttcattggcgaaaattcaaaatcatccagcgagaacggattcgccccagccggttgttcgccggaataacgttgttgttgagtttgcgcaaactgacgagccagttcagcctctgccgcagcatctgcatcttctgcgtttacgggcacatcatgttgatactgttcgccatagcgttgctgctgtgtctgggcgaactgacgtgccagttcatcctgctgcatcgcatcgatttcatcatcgttgtactgatcgccagaatcgtactgattgcgctgggcttcacgggctttttcttccgccgcacgctgtgagggcagcttaataccgtaagacgccaattcacgacgagttggcacgcggatacgtttcggtcgtggcaactgcgggccaatcccctctttgacctgcggacgcggtccaccgctatttgccagactgaagactggcgcggcaacggttgcggcagcccccgtcgccagtgtcgcttttttcacgccagatgccagcggagaaacagcggcagcggcttctactggaggtactgctgcaacagaaggtgctttcagcgaagatttgatcggttctggttctttaaccggttctggaatcggttgataccaggccgcaagttgttcacgttcacgggctcgcttctcttccacttcttcaaagtagtaaagcggcggacgcgcgggttttgtctcttctacaacgggttcaggctccacaacaggctgctgttcaacaggttgcggctgttggtacaacggctcctgagcgactggctgctgataagtttgctcagtctggtatgtagactgtggagcaaaagtggattgctgctcttcggcttgccaggcgttacctgccaccgattgttctggcgcaggggcgtaatacgactgttgcgcagactgttccggcgcagttgcgtaatacggttgctgaacaggttgttccgccgcaggcgcataatacggctgctgtggctgtacaggttgttgcagcggctcattatattgcactgcaggctgcgcatattgtggctgctgtgggtaaccttccggtgcaggagcaatcaccggctctcccgtttgtggccccggtacaggctgccaggctactgtaggttgtgcaggtgcaacatcaacagaggcaacagatggcgtctgagtcacaggttcaaccggtgcagcccagctttgcgtcgccgtggtagcagcagctgctacagcaacaggttcggtaattggcgcaccgtttaataatggatcgtactcgtcatattctggctgcgttgcacgattgcccgaaaagaggacgtcgtcagggtcggcagccacaccgcgtgcagtgtaggtaatctcttcgtcatcatccatccgcttaccggagaacaacgcagcgtctgtttgccgccccatcggattaatgaatttttccgccaaccgtttacgacgcgctagcgcgccgcgaagaatacgagcacggcgtgattcatgctgtttgccgtgattttcatcttcatactcttcgtcatcttcatactcatcttcatcgacccaggtatcatcgcgacgggtacgattactggcgaaggtaagaatatttaaaatccagccgccgagtttttcagcaatggtcacccatgaccaaccggtgaacagcgtcaggcccgctgcccaaacgcagagcagcgcaatagttcccccgctactgtgtagcagtggttgtagcgtagtgcttagtaagctgccaatgacgccaccggaggcaaaataccagatatcgtcagcgttgattgccgccagaccacaggaggtaaggatgagcgccaaaacgccaatgatgcgtagcgaaacggcaaaataatcaatgtattcgtcgctggactgatgacgccaggcaaaccaacaaccgccgacaataatgacgggaatggtgtaagccatcacgccaaaaataaagaacagcgtatctgccagccacgcaccgggcatcccacctaaattatggataggttcatgccaggccgtttgcgaccagctggggtccgaagggttaaagcttagtaaggcagccatcaaccagacggcaaacaggacaataaggatcagcaacgcctccagaaggcggcggccgctacttaactttgtcaatgtgacttctttgtcttcagtgtattcctggctcaagaaaggctctccaggttacaggcttttcctgcccgatgctaaaacggacaacagtaccaggttaccccagtactgttgctgtatggattaacaggagtgtaatcaaaatacgccgattttgcacctgttccgtgttagcgcgtcttaataaccagacgattactctgcttgacttcttccataacaacgtatgtccgtgtgtcattgacgccaggcagacgcagcagggtttcccccagcaacttacggtaagctgacatatccggcacgcgtgttttcaacaggtagtcgaaatcaccggatactaaatgacactcctgaatttcttcaagtttttgtacagcggtattgaattgttcaaacacatccggtgcgccacgattcagagtaatctcaacgaataccagaagtgatgcatccagataatgggggttcagcagcgccgtatagccctgaataaacccttgtctttccagccgacgcacacgctcaaggcacggcgttggggaaagtcccacacgtttagaaagctcgacgttagaaatacgcccatccttttgcaactcattaagaatgttacgatcgatacggtcgagatctttgccagggcgcttcttgctatctaccattattattgtctctctgtattccttccctactcctgtctgaccctgaaacatcactgttcagagtcgctacccgtcacgatagaccgaaatcatgaagattcacggcgcgcaatgcctgggtctacggtgagaagaccgttgccttgtggcagctatcgacatcacgaatggcgtctgtccacgccatacgtagatttcactagcacggtaaacatggtatttacatgcatggttatgcgcatataagaatactgtttttttttcttcctcgaatgttttcgcaaaacaccaggggattgtcaaagcaaaacatcgatttttagtacaacatgccagatattcattaccagaggcgtttattcatcatttaattggcttataaagcgggaaatttaagtagcagaggtgataatgacgggagaatttgaccgtcttatcgatgctgccgattgcacaaattgttaacaaaatcgtcatactctttttttacgtctgtaaattccctacaattctgcccattgtctgccaacaactatggggatctcatgggcacgaccaaacacagtaaactgcttatcctgggttcaggcccggcgggatacaccgctgctgtctacgcggcgcgcgccaacctgcaacctgtgctgattaccggcatggaaaaaggcggccaactgaccaccaccacggaagtggaaaactggcctggcgatccaaacgatctgaccggtccgttattaatggagcgcatgcacgaacatgccaccaaatttgaaactgaaatcatctttgatcacatcaacaaagttgatttgcagaatcgtccgttccgtctgactggcgatagcggcgaatatacttgcgacgcgctgattattgccaccggagcttctgcacgctatctcggcctgccatctgaagaagcctttaaaggccgtggagtttctgcttgtgcaacctgcgacggtttcttctatcgcaaccagaaagttgcggtcatcggcggcggcaataccgcggttgaagaggcgctgtatctgtctaacatcgcttcggaagtgcatctgattcaccgccgtgacggtttccgcgcggaaaaaatacttattaagcgtctgatggataaagtggagaacggcaacatcattctacacaccaaccgtacgctggaagaggtgaccggcgatcagatgggcgtcactggcgttcgtctgcgcgatacgcaaaacagcgataacatcgagtcactcgacgttgccggtctgtttgttgctatcggtcacagcccgaatactgccattttcgaagggcagctggaactggaaaacggctacatcaaagtacagtcgggtattcatggtaatgccacccagaccagcatccctggcgtctttgccgcaggcgacgtgatggatcacatttatcgccaggctattacatctgctggtacaggctgcatggcagcacttgatgcggaacgctacctcgatggtttagctgacgcaaaataattttacaaatcagtaacaaaagtaaagaaggcgacaccatgcgactatgggtcgcctttattttttcctcgttgtaacattgctctgcaaataattctgataactcacctgctaagcgtgcaatgaataaatcccgtcaaaaagagttaacccgctggttaaaacagcaaagcgtcatctcccaacgttggctgaatatttctcgtctgctgggctttgtgagcggcatattgatcattgcccaggcctggttcatggcgcgaattctgcaacatatgattatggagaatattccccgtgaagccctgctgcttccctttacgttactggttctgacctttgtactgcgcgcatgggtggtctggttacgcgaacgggtgggttatcacgccgggcagcatatccgctttgccatccgccgtcaggttctcgaccgtctgcaacaagcagggccagcgtggattcagggtaaaccggcggggagctgggcgacgctggtactcgagcaaattgacgatatgcatgattactatgcacgctacctgccgcaaatggcgctggcagtgtcggtgccgttgctgattgtggtggctatcttcccctctaactgggctgcggcgctcattctgctgggcactgctccgttaattccgttgtttatggcgctggttggaatgggggctgccgatgctaaccgacgtaactttctcgctcttgctcgcttaagtgggcattttctcgatcgcctgcgcggcatggaaacattgcgtatttttggtcgtggtgaagctgaaattgaaagtattcgttctgcttcggaagatttccgccaacggacaatggaagtgctacggctggcgtttttatcctccggcattctcgaattttttacctcgctgtcaattgctctggtggcggtctactttggtttttcctatctcggcgagctggattttggtcactatgatactggcgtgacgctggctgcgggttttctggccctgatccttgcgccggagtttttccagccattacgcgatctcggtacgttttatcatgctaaagcccaggctgttggcgcagctgacagtctgaaaacgtttatggaaaccccgctcgcccatccgcaacgtggtgaggcggaattagcatcaaccgatccggtgaccattgaagccgaggatctgtttattacatcaccagaaggtaaaacgctggctggaccgctgaactttactttgccagcaggccaacgtgcagtgttggttggtcgcagcggttcaggtaaaagctcactgctgaacgcgctttctggttttctctcatatcagggatcgctacgaatcaacgggatagaattacgcgatttatcaccggaatcatggcgtaaacatctctcctgggttgggcaaaacccacaattaccggcagcaacactacgggataacgtactactggcacgacctgatgccagcgaacacgagttacaaacagcgctggataacgcctgggtcagtgagtttctaccgctcctgccacaaggcgttgatacgcctgttggcgaccaggctgcccgcctttccgtggggcaggcacagcgcgtggcggtggcccgagcattactaaatccctgttcgctattactgttggatgaacccgctgccagccttgatgctcacagtgaacagcgcgtaatggaggcgcttaatgccgcctctctgcgccagacaacgttaatggtcacccaccagttagaagatcttgctgactgggatgtcatttgggtaatgcaggatggtcagattattgagcaaggacgttacgcggaattaagtgtggctggtggcccattcgccacattactggcccatcgtcaggaggagatttaaatgcgcgctttgctaccctatctggcactgtataaacgtcataaatggatgttaagtcttggtattgtgctggcaattgtcacgctgctcgccagtatcggtctgttgacactttccggctggttcctctcggcctcagcggtagcgggggttgccggactgtacagcttcaactatatgctacccgctgcgggcgtgcgtggtgcagcaatcacccgtactgccgggcgctattttgaacgtctggtaagtcacgacgcgactttccgcgtgttgcagcatctgcgcatttataccttcagcaaattgctgcccctctcccctgcaggactggcgcgctatcgtcagggcgaattgctcaaccgcgtggtggcggatgttgatacgctcgatcatctttacctgcgcgttatctcgccgctggtgggcgcttttgtggtgattatggtggtgacaatcgggttaagtttccttgatttcaccctcgcctttacgctgggcggcattatgttactgacgcttttccttatgccaccactgttttatcgtgcgggaaaaagcaccgggcaaaatctgactcatcttcgcgggcagtatcgccaacaactgacggcctggctgcaagggcaagctgagctgaccatttttggtgccagcgatcgttatcgcacgcagttagagaataccgaaattcagtggctggaagcgcaacgtcgtcaatctgaactcaccgcattgtcgcaagcgataatgctgctcattggcgcgttagcggtgatcctgatgctgtggatggcgtctggcggcgttggcggcaatgctcaacccggcgcgttaattgccctgtttgtcttctgcgcgttagccgcgtttgaagcactggcaccagtaacgggtgcatttcagcatctggggcaagtcattgcctctgccgttcggatcactgacttaacggatcaaaaaccggaagtcaccttccctgatacccaaactcgtgttgccgatcgcgtttcgctgacgttacgggatgttcaattcacttatccggagcaatcccaacaggcacttaaagggatttctcttcaggtaaacgccggggaacatatagcgattctcgggcgaaccggatgcggcaaatcaacactgttacaactgctgacccgcgcatgggacccgcaacaaggcaagattttgcttaacgatagccccatagccagcctgaatgaagcggctctacgacagaccatcagcgttgttcctcagcgagtgcatctgtttagcgccacgctgcgtgataatctgttactcgcctcacctggcagtagtgatgaggctctggcggagatcttgcgtcgcgttggtctggagaagctgctcgaggatgcaggtctcaacagttggttgggtgaaggcggacgccagctctccggtggtgaactgcgccgtctggctatcgcccgtgcgctgttacatgatgcgccgctggtattgctggatgaacctacagaaggcttagatgccacaaccgaaagtcagatccttgaattgcttgcagaaatgatgcatgagaaaacggtgttaatggtcacccatcgacttcgcggactctctcgtttccaacaaataatagtgatggacaacgggcaaattattgagcaaggtactcacgcagaactgcttgccagacaggggcgttattaccagttcaagcagggtttgtaagctattattgaacgatccgacttgcgtggagttttgcggtcatgcgcctggttcagctttctcgccattcaatagccttcccttccccggaaggcgcattacgtgagcctaacggcctgctggcactggggggcgatcttagccctgcgcgcctgttaatggcttaccagcgtggtatttttccgtggttttctccaggcgaccccatcctctggtggtcgcccgatcctcgcgcggtgctttggcctgaatcactgcatatcagccgtagtatgaagcgatttcataaacgctcgccctatcgagtcacgatgaattacgcttttggtcaggtcattgaaggctgtgccagcgatcgcgaagaaggaacctggatcacgcgtggcgtggtcgaagcctaccatcgccttcacgaactcggtcatgcccactctattgaagtctggcgtgaagatgagcttgtcggcggtatgtacggcgtggcccagggaacgctattttgtggcgagtccatgttcagccggatggaaaatgcgtctaaaacggcgcttctggtattctgtgaggaatttattggtcatggcggtaaacttatcgactgccaggtccttaacgatcacacagcgtcgcttggtgcctgcgaaattccccgccgggattacctcaattatctcaatcaaatgcgcctcggacgattgccgaataatttctgggtaccacggtgcttgttttcaccacaagaatgaatgttttcggcacatttctccccagagtgttataattgcggtcgcagagttggttacgctcattaccccgctgccgataaggaatttttcgcgtcaggtaacgcccatcgtttatctcaccgctcccttatacgttgcgcttttggtgcggcttagccgtgtgttttcggagtaatgtgccgaacctgtttgttgcgatttagcgcgcaaatctttacttatttacagaacttcggcattatcttgccggttcaaattacggtagtgataccccagaggattagatggccaaagaagacaatattgaaatgcaaggtaccgttcttgaaacgttgcctaataccatgttccgcgtagagttagaaaacggtcacgtggttactgcacacatctccggtaaaatgcgcaaaaactacatccgcatcctgacgggcgacaaagtgactgttgaactgaccccgtacgacctgagcaaaggccgcattgtcttccgtagtcgctgattgttttaccgcctgatgggcgaagagaaagaacgagtaaaaggtcggtttaaccggcctttttattttgtgatatgtatgaagtactttggaagtataaatccataacttgtctcgatgtagatatactgcacaacttgtttacagtatgagcaaacaataattatcattaaaattcttcttgaccgttttactccaactccctatagtagcgccccgttgccacccatgaggtttggcagcaaaacaatttggtgaggtgtccgagtggctgaaggagcacgcctggaaagtgtgtatacggcaacgtatcgggggttcgaatccccccctcaccgccatattcaaagaagagctcgtacgaaagtgcgagcttttttttcgcatattgcactccaagggggatgagaagccccgaccggggttcgacaactggcgcagccagttggacagaccacgaacacagtgagtgggctgcccgcagggcgagcgaagcgagtcaatccccccctcaccgccatattcaaagaagagctcgtacgaaagtgcgagcttttttttcgcatattgcactccaggggggatgagaagccccgaccggggttcgacaactggcgcagccagttggacagaccacgaacacagtgagtgggctgcccgcagggcgagcgaagcgagtcaatccccccctcaccgtcatatttaaagaaaagcgcgtacgaaagtacgagcttttttcgcattttatctgcctgttcgacagtgaaccagcagaggagcaacagttcgttaagtacgaatttctaagcagcctgtacggcagtgaaccatcaacatccacttcatttgccgaatacagctttctaagctgcctgtacggcagtgaacgcgttcgcaaaggttttaccgcaccccgtcgatttctaagctgcctgtacggcagtgaactcaaatactacacgtttagctcgttgttaataaagcaaaatcatctcattttcctgctggcacccttttttattcttaccttccagcaccattaattatcaacaacttaccttcacctccaaaaatagggttttcaccgccccagcctacaaacaaaaagtccgtaacctctttcgagattacggacttcaccaacctacctgacaatcagattaatgcgctgcttccgccttgtgcttttgtgcactctggaatccataagtcagctcatttttctctttatccagcgcaaccgtcacctgaccgccgtccaccagcgaaccaaacaacagttcgttggcgagcggttttttcaggttgtcctggatgacacgcgccatcggacgtgcgcccattgcccggtcgtaacctttctcggccagccagttacgcgcttcctggctcacttccagagaaacacctttctgatccaactgaacctgcaactcgacgatgaatttatccactacctgatggatcacgtcggtggagagatgatcgaaccagataatgttgtcgagacggttacgaaactccggcgtaaagatcttcttgatctcttccatcgcatcggtactgttgtcctggtggataagaccaatcgatttacgctcagtttctcgtaccccagcgttggtggtcatcaccaataccacgttacggaagtccgctttgcgtccgttgttatcggtcagcgtaccgttgtccatcacctgcaacagaatattgaacacgtccgggtgcgctttctcgatttcgtccagcagcagcaccgcatgtggatgcttgatgaccgcatcagtcagcaaaccgccctgatcaaaaccaacgtatcccggaggcgcaccaatcagacggctgacggtatggcgttccatatactcggacatatcaaagcgcagaagctcaatgcccaaagctttcgaaagctgtaccgtcacctctgttttcccgaccccggtagggcctgcaaacaggaacgaaccgaccggtttatgttcgtgacctaaacctgcacgcgccatcttaatggcttcagtcagcgcctcaatggctttatcctgaccgaagaccagcattttcaggcgatcgccgaggtttttcagggtatcgcggtcactctgcgaaacactcttctctggaatgcgcgcaatacgggccaccacggactcaatatccgccacattaacggttttcttgcgtttgcttaccggcatcaggcgtgcgcgagcgcccgcttcgtcgataacgtcaatggctttatccggcagatgacgatcgttaatgtatttcaccgccagctctaccgctgcacgcaccgcttttgcggtataacgcacgtcgtggtgcgcttcatacttcggtttcaggccattgatgatttgaacagtttcttcgatcgacggttcagtaatatcaattttctggaagcgacgcgccagagcacggtctttctcgaaaatgttgctgaactcctgataggttgtcgaaccaattacgcgaattttaccgctggagagcagcggtttgatcaggttagccgcatcgacctggccaccagaggctgcacccgcaccgataatggtgtggatctcatcaataaacaggatgctgttagtatcctgctccagctgcttgagcaacgctttaaaacgtttttcaaagtcgccgcgatattttgtgcccgctaacagagaaccgatatcgagagagtaaatcgtacagtcagccatcacttccggcacatcgccctgaacaattcgccaggcaagaccttccgcaatcgcggttttaccgacaccagattcccccaccagcagcgggttgtttttacggcgacggcagagaacctgaatagcacgctccagctccttctcacgaccaatcagtgggtcgattcctcccacgcgcgcaagctgattcaggttcgtcgtgaaattctccatacgttcctccccaccagcttgttcttcgctgtttggctggctgccaggatcagaagactgtgtcggctcgtctttacgcgtgccatgagagataaagttcaccacatcgagacggctgacttcatgtttacgcaacagatatgccgcctgcgactcctgttcgctaaaaatagcgaccagaacgtttgcaccggtaacctcattgcgaccggaggactggacatggaagaccgcacgttgcagtacacgctgaaaactcagcgtcggctgtgtgtcgcgctcctcttcactggcaggcagaacgggtgtggtttgttcaataaaggcttccagttcctgacggagcgcaaccaaatccacagaacacgcttccagcgcctcccgggcagatgggttactgagcagcgccagtaacaagtgctcgacggtcataaactcatgacggtgctcgcgcgctctggcgaaagccatatttaaactgagttccagttcttgattgagcataggcacctcccccaatttttatgcctgcattcaggctttttctagcgtacacagcaatggatgctcattctccctcgcgtacttgttcaccatcgccactttggtttctgcaacctcggcggtaaagactccgcaaatggccttcccctggtagtgaacagcgagcatcaattgcgttgcacgttctacatcataagaaaagaatttttgtaacacgtcaataacaaactccatcggagtgtaatcatcattgactaatatcactttatacatagatggcggttttagcgcgtcgcgaactttttcttccgccagttgatcaaagtccagccagtcgttcgttttacccattgtcagttatcatcttcggttacggttatcggcagaacgccctgccgctgacaagagcttatttgcctgaccaatctactccacatgatagataactatcatctatcgttggcatcagcgacatctgtcacattcctgtcaatagcgttaactgcttcaaatttttgattcatacctgccccctggcccctgtcaaatgcttgacggctcgccctaattctctaaattgtatttctagagttggcgaggttttgaacagccccctctctgaccccggtttattccatcttacttgtataagatttgcgaaggatgtcgaagcatggaaaagggtactgttaagtggttcaacaatgccaaagggtttggtttcatctgccctgaaggcggcggcgaagatattttcgctcattattccaccattcagatggatggttacagaacgctaaaagctggacaatccgttcagtttgatgtccaccaggggccaaaaggcaatcacgccagtgttattgtgcccgtcgaagtagaagcggcagtcgcatagctcttctgtctcattgtgtacatcctaaaggcaaaatgccagcccgatcggctggcatttttatctcaaaattactctcgtgccagagcatctactggatccagtcgtgccgcatttcgtgcgggtaaccagccaaataaaatcccggtgaccgtcgagcagagaaacgccagcagcagcgccaaaggtgaaaaaccaatctcccagccgggtaagaaaagctgcaaggtgaaagcaattaacagtgacagtgttattcccaacgcgccaccgaccaggcaaaccagcacggcttcgatcaggaactgttgcaaaacatcgcttgctcgcgcacctacagccatgcgaatgccaatttcccgcgtccgctcggtcactgacaccagcataatattcattacaccaataccgcccaccaccagcgaaatcaccgccaccagcgtaagaaacagttgtaaagtacgtgtggtcttttcaacggttttcaagacgccgtccatgttccaggtaaagaaatccttcttaccgtggcgcagtgaaagtaaacgcgtgagttgctgttccgcctcggcgctgtcaaatccttctttcaccctgacagtaatggagttcagccacgactggcccataactcgcccggacatcgtgctgtaaggtagccagacacgcagcactttactgctaccaaacatcgactgtttttcttccgccacaccaatgactctggcgggcatattgccgaccagaatcacctcgccaaccacatctgctttatgggggaaaagctggcggcgagtattactgtcgagcaccaccacctgcgcacgaccgttcagctgctcctgattaaaggtgttcccttcactgaaggtcatgccatagacattaaaataatcgccgctcacgccattggcactggcagcaacatcaacattgttataacgcaggcgcaggttttgcgagacggcaggtgtggctgaggcgacccacggttgtttttggatggcgattaagtcatcgtacttcagcgcctgctgatattgcggatcgtcatcgccaaaatctttcccgggatagacatcaatagtattcgtaccaatagaacgaatatccgccagcaccatttgtttggcggcgtcgcccaccacgacaattgaaaccaccgacgcaataccgataataatccccagcatggtcagtaaagtacgcattttattcgctgccagcgccctccatgccatcgtcagcgcctcgttaaaaccactgacaaactgccgccagccagaggccgtgttgacaacaggttccgtcccgccagcaacattcactttttcaacggcgggaggattgcgcacaatttcgccgtcgcgaatttcgatcacccgctcggcctgagcagcgacctgcggatcgtgggtaacgataatcaccgtatgcccgcgatcacgcagctgatgcaggatcgccatcacctcttcgccagaatggctgtccagtgcgccggttggttcatcggcaagaattacctgaccgccgttcatcaatgcccgcgcgatgctgacgcgctgttgctgaccacccgaaagctgtgccggataatactctgtacggtcttccagccccagtcgttgcagcaactcctgggcgcgaagcagccgctgtttccgctcaagaccggcatagacggcgggtacttcaacgttctgctcggcggttaaatgcgaaagcaaatggtaacgctggaaaataaagccgaagtgttcgcgacgcagttgcgccagcgcatcggcgtccagcgtggcaacatcctgaccggctacgcgataggtgccgctggtggccttatccaggcagccgagaatattcatcagggtcgatttaccggaacccgaagcgccgacaatcgccaccatctcaccagcataaatatcgagggtgatgcccttcagcacctcaacctgctcatcaccggcaggatagctgcgacgaatatcctttaattcgagcaaaggcgtcattgtgcagctcctggtttggcctcaccaatcaccacttcatcgcccgcgtccagccctttgacaatctcaacatcggtatcgttacgtgcgccaatcgtcacttcacgttcgcgtgtttcaccattacgcaacaatttgactttataacgattatcgccaaccggatcgcctaacgccgacagagggatcgtcagcacatttttcacatcggtgagctgaatatgcacttgcgcggtcatatccagccgcagcaaaccattggggttggggacttcaaaacgggcgtaatagaaaatagcgtcgttaaccttttccggcgtcggtagtacatccttgatttgcccctcgtagcgcgtcagtggatcgccaagtaccgtaaaccaggctttttgccccggcttcaggtggattacatccgcttcagaaacctgcgcttttaccagcatggtgctcatatctgccagcgtcagaatgttcggtgcttgttgtgcggcaatcaccgtctggccttgcagagtggtgatttgcgtgacttccccggccatcggagcaacgatgcgggtgtaatcgagattggttttagccgtagcgagtgaggcctgattgcgcttgatttgcgcgtcaatggtgccaatttgcgcctgtttcacagccatctccgtcgcggcggtatcgagatcctgctgtgaaaccgcttgcgtttgtgcaagacgttgctgacgggaatacgtcacccgcgccagtttcagctccgcttccgcctgctgccgctgcgcgcgtagctccatcagcgttgcttccacctccttaatctggttttcagcctgttcaggatcaataacccctaaaagctggtctttttttactttatcgccaatcgccaccgacagcgttttcaactgaccgctgacctgcgcgcccacatcaaccttacgcagcgcgtccagctttccggtcgccagcacgctttgctgtaaatcaccggggcgcacaatcagcgtctgataagtcggcacgggtgcgttaagaattctccataacgtaatcagcccggcaatgactatcaccagcgcaataacgtaacgcttcttcacggttttccgctttttcataaatattctgaatactccatatgccaatccgggtcattaacttcaacgaaatatcaacaaaaccctaaaatttacgttagtaatcacactattgatgtttggttaagatacgcaatggtgaaatcgacgtcatgtataaccattgatttcatgaatatgtcgcagctaactgaacggacctttacgccatctgaatctctcagcagcctgtcactttttcttagtctggcacgtggacagtgtcggccgggtaaattctggcatcgccgtagttttcgccagaaatttttgctgcgctcgttgattatgccgcgtttaagcgttgagtggatgaacgaactttcccactggcctaatctcaatgtgttgttaacgcgccagccgcgactgcctgtgcgtctgcatcgcccttaccttgcggcgaatcttagccgtaagcaattgctggaggcgttacgttaccattatgcgttactccgcgggtgtatgtcggcggaagaattcagcttatatttgaatacccccgggctgcaactggcgaagctggaaggcaaaaacggcgagcagttcacacttgagctgaccatgatgatctcaatggataaagaaggtgacagtacaatcctgttccgcaacagcgaaggtattcctctggcagagatcacgtttaccctgtgtgaatatcaggggaaaagaacaatgtttattggcggactgcaaggcgcaaaatgggaaattccacatcaggaaatccagaatgcgacgaaagcctgccacgggctatttcccaaacgccttgtgatggaagcggcctgtctgtttgcccaacgtttgcaggtagagcagatcattgccgtcagcaatgaaacacatatttaccgcagcctgcgttatcgcgataaagaaggcaagatccatgctgattacaacgcgttctgggagtcggttggcggcgtatgtgatgctgaacgccattaccgccttccagcacagatagcacgaaaagagattgccgaaatcgccagtaaaaaacgggctgaataccgtcggcgctatgagatgctcgacgctattcagccacaaatggccacgatgtttcgcggttaatccgcgcgaccgcgcgccagccacagcacgcgtgagaacatttttttcagcagcgtcggtacggaatccacaccacgacgtcctgcctccattgccacttcaatggcaagatcgggtttggaagagcgatggatcgctttcgagataattttgcgcagattcatcggtacattttccgggatttgcgccacgcggtggaacacatcggaaaatccctggcgatacataaaatgttccatatccagcgccggtaacgccgttaaatgttctcgttcggcttcccgatcgttattcaacaggctgcgtaccgtagcggcatatttcttccctgcttcatcgccatcgaccagtacatgccattcaatccccattcgccgggcaaatttaaccagtggctttagcccggactgggcaaactcaatgaccttgatcccttcagcatcaaaatgatgtccgcactgacgcgccagttcattgataacccaggtttccgtttccccttccaccagcagccagcagcgtgcaaacagcgatgatggacgattaaaacgaatgtggaaagagatgcgtcggctatcttcggtactcaaaccactcggccccagacgccaggcggcaacgcgcgaggactcacgtaccagtcggcaaacatgctctaccggcgttaacgaaagcaactcacccgagttggtggtggcaatgcgctgcaatggcagaagattcaacagatgccaggcaactgaaagcataatggggtgtaaacgggtttctggatcttcgatcagcaacaatggacgggcgtctttatccagtcgcaatgtgccttttgcctgcaacaaagtagcaaacaggccgagcaaaataacccgatacgagcgccctccaggtcggtcaatcatccggttgatgatatccagatagcgccagcttcgttgctcattgctggctcgccgccgcattaaacgatatcgcgcctgtccggccccctgctcagagaaataatgctcaagcagctgtaccattgcggaaagtccctgacgaatctgcccatcagagagattttgcggatgtgaggataactcacgggcgaggaaatcgagctggcgcgcggtgacttccacattagggacatttggcaccgtgccgttacgaatacggcgcataaaacgggcatcacgcaagcgcagcaccggcattaaacgcaccagatggcgtgcctggtcgttaatatcctcgacatcaatcggatgtccgtctttatcgagaaaactgcgcagtgtcatcacgctgccgtcttccgcactctccccttccagacgataaaaaatacggtgatagccatcagtgcatggcgtccagcacgcttccagcggccgatagcggcgaacccgatgtcggcctggcagcgattcgcggaaggtcaaaataatatgcagatgatgttctcgcccgttgatatctcccggcgggaaccagaaatcgtcgcgctcaaaatggtagagatctgattctggcgatagcagcagggttaaggcgtccagcaagctggatttaccccacgcgttctccccaatcaggacgttgttttgttccagcatcaacgacaaacggttgataccgcgaaaacccacaatttcaacgcgctcaagaatcatatcccctccagaaatatgtgacttatcctttacgctggcagtataacgggaaaggccatgctaatacgtgatgacatcacatttaagcatggcaaatgtctgaaaaatgagcgaataatcgcgttatactccctcttgctgataagcctgcaaaaacaacaaaatcaaataattagcatgataaattattttttattacgcctaaaggattaaatcttttgcttgcactacactgtcaatcagacaaatgactatatggggcaacccgctgttgccctaaatcaaatttactggatttatttatctggtgaatgactcgccttcgtttttaaaatagccgcgcattatttccgtcgtcacttttttacgacgaccctataaaacgaccatatttttcacagggtcaatttttaattgaggtggatatgttcagaaaattagcagctgaatgttttggtactttctggcttgtttttggtggctgtggtagtgccgtactggccgcaggcttcccggaattaggcattggttttgccggcgtggcgctggcattcggtctgaccgttctgacgatggcctttgcagttggtcatatttctggtggtcattttaacccggcggtcactattggtttatgggctggcggacgtttcccggcaaaagaagtcgttggctacgtaattgcccaggttgtcggcggtattgttgcggcggcgctgctgtatttaattgccagtggtaaaacgggttttgacgcggcagccagcggttttgcttctaacggttatggcgagcattcgccaggcggttattccatgctttccgcactggtagttgaactggtattgagtgcaggtttcctgctggtgatccacggcgcaaccgacaaattcgctcctgctggttttgcgccgatcgctattggtctggccttaaccctgattcacttaatcagtattccggtgactaacacttctgttaacccggcgcgcagcaccgcggttgctatcttccagggcggctgggcattagaacaactgtggttcttctgggtggtgccaattgtcggcggcattatcggtggtctgatttaccggaccctgctggaaaaacgtaattaattaacgcagaaggcctggcgcaatgtcaggccttttttaaatatattgattcatcttcctgttgcgctccttgatgtgttaagccacatatagtcactggcgcagggagcgcgcagggggcggccaatcgccgccgccccctgcacccccgggctctggcgaacaaaatcgccgctgcgcggtgccctcgacttatcccttgcggctaccgggtcgggcgcgaggtaacatccctgtaaaacgcgccctcagcccacatccatgtgggctgccccggccttcagggaacgcctcggcgattttgacgccaccaacaccggtgcggtttgtaattaaagcgcaagaatatctttaaatgaaaatgaataccctaccgatccttatgcataacatttccttttaattgcaactttactcgtccttccgctttcagtagtgtgtcatcgcgcatttcgacttcatctttgcaaggactgggttttcatgttttctgggctgttaatcattctggttcccctgattgtgggttacctcattcctcttcgccaaaaagctgcattaagagttattaatcagctattaagctggatggtttaccttattctcttttttatgggtatcagtctggcgtttctcgataacctcgccagtaacctgttggcgattctgcattattccgccgtcagtattaccgttattttactgtgtaatattgccgcccttatgtggctggagcgaggcctgccatggcgcaatcaccatcagcaagaaaaactcccgtcgcgtattgcgatggcgctggagtcgctaaaactgtgcggcgtagtagtgattggttttgccattggcctgagtggactggctttcttacaacatgcgaccgaagccagtgaatacaccttaattctgctacttttcctcgtcggtattcagttgcgcaataatggcatgaccttaaagcagattgtccttaatcgccggggaatgattgtcgccgtggtggtggttgccagttcattaactggtggtttaattaacgcctttattcttgatcttcccatcaataccgcgctggcaatggcctctggtttcggctggtattctctttccggtattttattgactgaatcttttggtccggtaatcgggagcgcggcgttttttaatgatctggcccgtgagctgattgcaattatgttgatccctgggctgattcgccgcagccgctctaccgcactgggcttatgcggtgccacatcaatggatttcaccctgcccgttcttcaacgtactggcgggctggatatggtcccggcggcgattgttcacggttttattcttagtctgttagtgccgatcctcatcgcctttttttccgcgtaatacctctctggcggtagatccctgccgccaaaattgcgctaaatcaatctcccttaaagttgcatgaaaaatcccttttatccccgcgttaagcgtcttaaccttaaacatgtatattaaatataactttaaaaggtgtgatcatgttttgtgtgcaatgtgaacaaactatccgtactccggcaggaaacggctgctcatacgcgcaggggatgtgtggtaaaacggcggaaacctctgaccttcaggatttactcatcgcggcgctgcaagggctttcggcctgggcggtaaaagcgcgtgaatacggcatcatcaaccacgatgtagacagctttgcgccacgcgcatttttctcaaccctgaccaacgttaacttcgattctccgcgtatagtcggctacgctcgtgaagcgattgccctgcgcgaggcgctgaaagcacaatgcctggctgtagatgccaacgcccgcgtcgataacccgatggctgacctgcaactggtgagcgatgatcttggcgagctgcaacgtcaggcagcagaatttacccctaacaaagataaagcggcgattggcgaaaacattctcggcctgcgcctgctgtgcctgtatggcctgaaaggtgcggcggcctatatggaacacgcgcatgttctcggtcaatacgacaacgatatttatgcccagtaccataaaatcatggcgtggctgggaacctggcctgccgatatgaacgcgcttcttgagtgttcaatggaaatcggccagatgaacttcaaagtgatgagcattctggacgcaggcgaaaccggtaaatacggtcacccgaccccaacccaggtcaacgtcaaagcgacggcgggtaaatgcattctgatttccggtcacgatctcaaagatctctacaacctgctggaacagaccgaaggcacgggcgttaatgtctacacccacggcgaaatgctgcctgcgcatggctacccggagctgcgtaaattcaagcatctggtcggtaactacggcagcggctggcagaatcagcaagtggagttcgctcgtttccctggccccatcgtgatgacctcgaactgcatcatcgacccaaccgtaggcgcttatgacgatcgtatctggacccgcagcatcgttggctggccgggtgtgcgtcatctggatggcgaagatttctctgcggtcattgcccaggcgcaacaaatggcaggcttcccgtacagcgaaattccgcacctgatcaccgtgggctttggtcgtcaaacgctgcttggcgcagcggatacgctgattgatctggtaagccgtgaaaaactgcgtcatatcttcctgcttggcggctgtgacggcgcacgcggcgagcgtcactacttcaccgatttcgccaccagcgtgccggatgactgcctgatcctcactctcgcctgtggtaaatatcgctttaacaaactcgagtttggcgatatcgaaggtctgccgcgtctggtggatgctggtcagtgtaacgatgcttactcagcaattattctggcggtaacgctggcagaaaaactgggctgcggtgtcaacgatctgccgctgtcactggtgctctcctggtttgaacagaaagcgattgtcattctgctgacactgctttctctgggtgtgaaaaatatcgtcaccggcccgactgcacctggtttcctgacaccagacctgctggcggtgctgaacgagaaattcggcctgcgttctatcaccactgttgaagaagacatgaagcaactgttgagcgcgtaaggagtttgtcgatgacgatgccaacgaatcaatgcccgtggcggatgcaggttcatcacattacgcaagaaacgccggatgtgtggacgatttccctgatttgccacgattactacccatatcgcgccgggcaatatgcactggtcagcgtgcgtaactcagcggaaacgctgcgtgcttacaccatttcctccacgccaggcgtgagtgaatacatcaccctgactgtgcggcggattgatgacggagtcggctcccagtggctgacgcgcgatgtaaaacgcggtgattatctctggctttcagacgcaatgggggaatttacctgcgacgataaagcagaagataaattcctgttgctggcggcaggctgcggcgtcacgccgattatgtcgatgcgtcgctggctggcgaagaaccgtccgcaggccgatgtgcaggtgatctacaacatgcgttcgccgcaggatgttattttcgccgatgagtggcgcaactatccggtgacgctggtggcagaaaataacgttaccgaaggctttatcgctggtcgtctcactcgcgaactgctggcaggtgtccctgacttagcttcacgtaccgtgatgacctgcggcccggctccgtatatggattgggtagagcaggaagtgaaagcgctcggcgtgacgcgtttctttaaagagaaattcttcaccccagtagcggaagcggcgaccagcggtctgaaattcaccaaactgcaaccggcacgagaattttacgccccggttggcaccacgctactggaggcgctggaaagcaataaagttccggttgtcgctgcctgccgtgcgggtgtttgcggctgctgtaagacgaaagtggtttccggtgaatatacggtgagcagcacaatgacgctgaccgacgccgaaatcgctgaaggttacgtactggcctgctcctgccatccgcagggggatttggttctcgcataatcgccttatgcccgatgatattcctttcatcgggctatttaaccgttagtgcctcctttttcccccatcccttccccctccgtcagatgaactaaacttgttaccgttatcacattcaggagatggagaaccatgaaacaaacggttgcagcttatatcgccaaaacactcgaatcggcaggcgtgaaacgcatctggggagtcacgggcgactctctgaacggtcttagtgacagtcttaatcgcatgggcaccatcgagtggatgtccacccgccatgaagaagtggcggcctttgccgctggcgctgaagcacaactttcaggagaactggcggtctgtgccggatcgtgcggccccggaaacctgcacttaatcaacggcctgtttgattgccaccgcaatcacgttccggtactggcgattgccgctcatattccctccagcgaaattggcagcggctatttccaggaaacccacccacaagagctattccgcgaatgtagtcactattgcgagctggtttccagcccggagcagatcccacaagtgctggcgattgccatgcgcaaagcggtgcttaaccgtggcgtttccgttgttgtattaccgggcgacgtggcgttaaaacctgcgccagaaggggcaaccacgcactggtatcatgcgccacaaccagtcgtgacgccggaagaagaagagttacgcaaactggcgcaactgctgcgttattccagcaatatcgccctgatgtgtggcagcggctgcgcgggggcgcataaagagttagttgagtttgccgggaaaattaaagcgcctattgttcatgccctgcgcggtaaagaacatgtcgaatacgataatccgtatgatgtcggaatgacgggattaattggcttctcgtcaggtttccataccatgatgaacgccgacacgttagtgctactcggtactcagttcccctaccgcgccttctacccgaccgatgccaaaatcattcagattgatatcaacccagccagcatcggcgctcacagcaaggtggatatggcactggtcggcgatatcaagtcgactctgcgtgcattgcttccactggtggaagaaaaagccgatcgcaagtttctggataaagcgctggaagattaccgcgacgcccgcaaagggctggacgatttagctaaaccgagcgagaaagccattcacccgcaatatctggcgcagcaaattagtcattttgccgccgatgacgccatctttacctgtgacgttggtacgccaacggtgtgggcggcacgttatctgaaaatgaacggcaagcgtcgtctgttaggttcgtttaaccacggttcgatggctaacgccatgccgcaggcgctgggtgctcaggcaaccgagccggaacgtcaggtggtcgccatgtgcggcgatggcggttttagcatgttgatgggcgatttcctctcagtagtgcagatgaaactgccggtgaaaattatcgtctttaataacagcgtgctgggctttgtggcgatggagatgaaagctggtggctatttgactgacggcaccgaactacatgacaccaactttgcccgcattgccgaagcgtgcggaattacgggtattcgcgtggaaaaagcctctgaagtcgatgaagccctgcaacgcgccttttccatcgacggtccggtgctggtggatgtggtggtcgccaaagaagaattagccattccaccgcagatcaaactcgaacaggccaaaggttttagcctgtatatgttgcgcgcaatcatcagcggacgcggtgatgaagtgatcgaactggcgaaaacaaactggctaaggtaaaaagggtggcatttcccgtcataataaggacatgccatgattgatttacgcagtgataccgttacccgaccgagccgcgccatgctcgaagcgatgatggccgccccggttggggacgacgtttacggagacgaccctaccgttaatgctctgcaggactatgcagcagagctttccggtaaagaagccgccatttttctgcctaccggcactcaggccaacctggtcgctctgctcagtcactgtgaacgcggcgaagagtatattgtcggtcaggccgcgcataactatctgtttgaagccggtggcgcggcggtgctgggcagtattcaaccgcaacccatcgacgcggctgccgacggcacgctaccgctggataaagtggcgatgaaaatcaaacccgacgatatccatttcgcccgcaccaaattactcagtctggaaaacactcacaacggcaaagtgttgccgcgagaatacctgaaagaagcatgggaatttactcgcgagcgcaatctggcgctgcatgttgacggtgcgcgcatctttaatgccgtggtggcttacggctgcgaactgaaagagatcacgcaatattgtgattcgttcaccatttgcctgtcgaaaggacttgggacgccagtcggctcgttactggtcggtaatcgtgattacattaaacgtgccatccgctggcggaaaatgaccggtggcggaatgcgccagtccggcattctggctgccgccgggatgtatgccctgaaaaataacgtcgcgcgcttacaggaagaccacgacaacgccgcctggatggcggagcagttgcgtgaagcaggcgcggatgtgatgcgtcaggacaccaatatgctgtttgttcgcgtcggggaagaaaatgctgccgcgttaggcgaatacatgaaagcgagaaacgtgctgattaacgcctcgccgattgtccgcctggtgacccatcttgacgtctcgcgcactcagctggcggaagtcgccgcccactggcgcgcattcctggcgcgttaaggagggagacgtgccgcaacgcattttagttctcggtgccagtggctacattggtcagcatctggtgcgaacactcagccagcaggggcatcagatcctggcggcggcacgtcatgtcgacaggcttgcaaagctgcaactggcaaatgtcagttgccataaagtcgatctcagctggccggataaccttccggccctgttgcaggatatcgatacggtctattttctggtgcacagcatgggcgaaggcggcgattttatcgctcaggagcgccaggtggctctcaacgtccgcgatgcgctacgtgaagtcccagttaagcaattaatctttctcagttcgttgcaggccccgccacatgagcagtcggaccatctgcgtgcccgtcaggctacggcggatattcttcgtgaagcgggtgtcccggtgaccgaattgcgtgccggaataatcgttggtgcaggttcagcggcgttcgaagtcatgcgcgatatggtctacaacctgccagtgttaacgccgccacgctgggttcgttcacgcaccacgcccatcgcgctggaaaacttgctgcactatctggtggcgctgttagatcatccggccagcgaacatcgcatcttcgaagccgccggaccagaagtgctcagttatcagcaacagtttgaacattttatggcggtgagcggtaagcgccgctggttgatccccatccccctcccgacccgctggatttcggtgtggtttctcaatgtgattacttccgtaccgcccaccaccgccagggcgttgattcaggggctgaaacacgatctgctggcggatgacaccgcgctacgtgcactcatcccacaacggctgatcgctttcgatgacgcggtacgtcgcaccctgaaagaggaagaaaagctggtcaactccagcgactggggatacgacgctcaggcctttgcccgctggcgaccggagtacggttatttcgccaaacaggcggggtttaccgttaaaacgtccgccagccttgcggctttatggcaggtggtgaatcaaatcggcggtaaagagcgttatttctttggcaatattttgtggcaaacccgggcgttgatggaccgcgcgatcggtcataagctggcgaaaggccgcccggagcgtgaatatttgcagaccggcgatgcggtggatagctggaaagtgattgtcgttgaaccggaaaaacaacttacgctgttatttggcatgaaagcgccggggctgggacgactgtgttttaccctggaagataaaggcgactatcgtactatcgatgttcgcgcattctggcatccgcacggtatgccggggctgttttactggttattgatgatccccgcgcatctgtttatttttcgcggaatggcaaaacaaatcgccagactggcagaacaaagcacagattaatcgacaaaacctgcgttattctttcatgtttcccattgcatcatgggggaaatcacggaagaatgcgcacgtcattttctcaacaacagtggattgatatgaaggtactggttaccggcgccaccagcggcttaggtcgaaacgcggtagagtttttatgccagaaaggcatcagcgtgcgagcgaccggtcgcaacgaggcaatgggtaaattgctggaaaaaatgggcgcagagtttgttccggcggatctgaccgagctggtctcatcacaagctaaagtgatgctcgcgggcattgatacgctgtggcactgctccagctttacctcgccctgggggacacaacaggctttcgatctggctaacgttcgcgccactcgccgcctgggtgaatgggctgtcgcctggggtgtgcgtaactttattcatatctcttccccctccctgtacttcgattatcaccaccatcgcgatattaaagaagattttcgccctcaccgcttcgccaacgagtttgcccgcagcaaagcagccagcgaagaggtgatcaatatgctttcgcaggcgaatccacaaacgcgctttactattctgcgcccacaaagtctgttcggaccgcacgataaagtctttattccccgtctggcgcatatgatgcaccactatggcagcattctgttaccgcacggcggcagtgcgctggtggatatgacctactatgaaaatgccgtgcacgccatgtggctggcaagccaggaagcctgcgataagctaccttccgggcgtgtgtacaacatcaccaatggcgagcatcgcacactgcgcagcatcgtgcagaagctgatcgacgagttgaatattgactgtcgtattcgttccgtcccctacccgatgctggatatgatcgcccgcagcatggagcgtttaggccgcaagtcagcaaaagagccgccgctgacccactacggcgtctccaagttgaattttgactttacgctggatattacgcgtgcgcaggaagagttaggttatcaaccagtcctcaccctggatgaaggtatcgagaaaactgccgcctggctacgcgaccacggaaaactgccgcgctaatcctgcccgtatttctccagcaacgcttcggcaatcgcctgagtttctgcatccgcttcgccgttgtataacgtcgggcggaaatgcatctggaacgccataatcacgcgccgctgctcgcgcggtgtcatatcaggtttaacgtcataaccgtagcgcgccaaaagctccagcaatgacgcggtatctaccggtgtgtgcggcgcgcgcccggcaaggtaaaagttcacccgctgcgcatccggccaggcaccaatcccctgctgcgccagttgttgccaggggaataacggccccggatcgtctttgcgctgcggcgcaatatccgcatgtgccactacgttttccggcttgatgtgataacgggcaataatatctttcgccagcggaataagcgcctgaatctgtgcctgttcaaacggggcaaaatatttcactccggctgatttctgccagccacggttttccagctcaatgccaatagaggtgtcgttaaggcgcgttgccccgcgccaggcgctaatccccgcatgccaggccagttcttcttccggcaccagttgccagatgcgcggtttaccgttgtatcgcggtggtaccgcagggaccagataatgcgagctgacctgcttatcggtcagtgtcgccagcgagctatcaaaatcatctgcggtgtagtggatcaccagcactttaatgcgaggatacgccgcctgcgcctggcgtcgggtatcaagctgatatccctctttctcgacaatgcctttttcgcctgcacaccctgccagtaacagagcggcggcgaccagccaaaagactcttctcatcgacgcgttttcaccgccgtaccgctgacgctaaccatcagcatactgccgttttgcccgaccgtttcgtagtcgatatcaataccaaccacggcatcggcccccagtgcccgcgcctgggagcctagttcctcaaaggcgatctcccgcgctttacgtagctctttttcgtaggcaccggagcgtccaccaacgatatcgcggataccggcaaagaaatcacggaaaatattggcacctaaaatcgcttcgccggtcaccacaccgcaatattcgacgatggtctggccttccagagttggggttgtagaaaattgcatgatcgatctccttgtttgttaagccttcgatctctaaagcattatcggactgatatgccatgttgggaagaaggttttgatcagtttaggaaatcatctcattgtgtcaaaaacaggtacataagcctgtacaattatccgttgcataacccgatattagttttattatggagcaccgcttacctgtcgtattatgtagtaccagcaacattaatgagtgggaagagtcaacttatattgtaaatgattcctaaagtcttccccatcttgcgcctgaggtatatatctctggattgctttttggtcagccgccgcaaaacaagaaagtaataagatctcaatgcttttgtcattaatataagcgaagatcattcttgcaaattcgtatataaacgcccggtcctgagcgcttaatagtttaatacaatatttatttttaagagaataaagtatttcaaggaaagcatccgcagcaaccttcacgttattaccggcgatcatattatatatatctcttgcacagatagagtacagagatagtaaacagccatacaaataatcatttattaattcttttgtccattttactggcaaccatggttttatcttgacaccatgcatactacagtcatgaaaaagacatttgctgaaattaactcttatcatatcaacattaaaaaaatggcaattaataaattttaaagaatgagtattcacattgttaattttaacagttctaaacgaaacgtttttgaatacattgtttactatattgctatttgttattttaacatcacctaaactgccgttttcaaaacaacattttttcaatatgctttcattcacaacagtgtgtgataaatagagattacttatgttttgctttattaatgccacgtcattaaaatgactatatttaataaagcaaccatcattgagtagtgttttaagattgactaaattagttgcatcttcacgtaccatcgtggcaactggaacaggcaacgacatgaaaacttcttcattcaccatcaagtggatcatgcattgcgttccctttgtcatatccacacttacgctacaaatatcgttgtaatgcgaagagtgcatttcaggaaacaaattaaacacggtatcttgaaaggcactaaatcgtgttaataaatcctgataatgaacaggttttgtttcaaaattatcatcagcaaatccaagcactattgcatgctctacatctaacgcagtttcaaatgactcttcttctgtaaaatcattatttaaaacctcacctgacgtattatcactgtcataaaaagtgctcatcaatgcgatattgtttgttacagcgtcttttgcgatattctcactaattgcatatcgcctgctataatcataaaaatgaataaacgcatcctttataaaggatatatattgctctttgttaaagtcaatacgactgtataatttttcaaaaatcacattcgcaatcttactacccatagtatgcctgtataataatgggtgcgattcaatcgtaaaatacttgtctaattgatgttgtaatttattctcatagtccagtgggaaaagaaatttttgtctttcaagtttcccattcgatatattacgtattccaatggtaattctttcattacccacttttatttcaacttcgttatcttctgatttgccaagatattttttaacatcaatctcgaaagcattactaaaaaatatattaaattgataattcgctgatggaatattttccgctagcaactcatcattttttatgagatcactatcagcatttattgctaatatcagatgcaagtagatggtgtcccatgtagacaactcacccttacgactggaatttaatatcgcgaaaaattccctcagtgaatcgaggaaattatcactttgattcagttgtgtgcctggaaatgatgatgcttgatcagatatattgtttatcatattaaaaatcacccaagggaaaagatattccactgaactcctcgtgctttattattataaaagcacaacgcatttatactcatattaattaacgaaatactgatacagtttgatttattcttcactcaaactcattagcttaaattctttacccacaactgtagcatatataatattatcaaaagtcaaagttgggactatcaaatttcgctcattttcaaaaatacaatgtaattttagcaatcatcttaatcgcaggatctcttattgcatgtgaaaaattctgtaatgattagacaataaccgcgttcatttatcacgcgttataaatgtgaaactggcttcttgcagatgctcttaacctctacaggaggatttatcccgccatttcagaactatcatatttaccttaaatgatcatttcagccatataacacgctcaacctcacaaatggtttacactgtctattgtttgggtaatttaagtaagtcagctacgagcaaccttgagtgggtagccagcaatggactcaaacccaatcaggtgttcagattgtttcagaattgtattaaaaacaatgtattaaataatctgataacgtttggtcgtagtgtgacgcagacagcaagctaataaggaaatgattatgcgctaccgttcactatctctacttattccatgtgcactgctgctgagtgcctgtaccaccgtcacgccagcttataaagataacggcccccgcaccggttcctgtgtccagggtggccctgacagcgtggctcaacaattctatgactaccgcattcaacatcgcagcaatgacattaccgccctgcgcccctatttgagtgacaaactggcaaccctacttagcgatgccagccgcgataatagtcatcgtgaattgttaagcagcgatccgttctccagtcgaaccaccttgccagacagcgcccacgttgccagtgcatcgactatccctaatcgtgatgcccgtaacattccattgcgcgtggatctcaaacagggtgaccaaggatggcaggatgaagtgttaatgattcaggaaggccagtgttgggtcatcgacgatgtgcgctacttaggcggtagcgttcacgccacagcgggtacgctccgtcagtccatcgagaatcgctaaagccttgatcaaccaataaaccccgtaaattgtccggcatttcgtgaggaatgccgacatttatgctcgccgaccaccgcccccgttattttgtgctatgtttattgaataatgcgctttgcttttaacttttaaagcagaaatattgcataattattctgtcaaaggtactatcttcgacctcaatagctatcagactgccagtatacgagtgtcaatgagtattcaattaaacggcattaattgcttctacggcgcgcatcaggcgctgttcgatatcacgctggattgcccacagggcgaaacgctggtgttacttggccccagcggcgcgggtaaaagctcgctgctgcgtgtactcaatctgcttgagatgccgcgctccggtacgctcaacattgcaggcaaccatttcgatttcaccaaaacaccctctgacaaagcgattcgcgatttgcgtcgtaacgttggcatggtgtttcagcaatacaacctgtggccgcatctgaccgtgcagcaaaacctgattgaagcgccctgccgtgtactggggttgagcaaagatcaggcgctggcccgtgcagaaaaactgctggaacgtctgcgtctcaaaccttatagcgatcgttacccgctgcatctttctggtggtcagcagcagcgtgttgctattgcccgtgcgttgatgatggaaccgcaggtactgctgttcgatgaaccgaccgccgcactggacccggaaattacggcacaaatcgtcagcatcattcgtgagttggcagaaacgaatattacccaggtgatcgtcacccacgaagttgaagtggcgcgtaaaaccgccagccgagtggtgtatatggaaaacggtcatatcgtagaacaaggcgacgcgagctgctttaccgagccgcaaaccgaagcatttaaaaactatctctctcactaatattcgggataacaacaatgaaaaaagttctgattgccgcgttaattgcaggttttagtctttccgccacagctgccgaaaccattcgttttgctaccgaagcctcctatcctccgtttgaatcgattgatgcaaacaaccagatcgttggttttgacgtcgacctggcacaggcgctgtgtaaagagattgatgcaacctgtactttctctaaccaggcgtttgacagcctgatcccaagcctgaaattccgtcgcgtagaagcagtgatggcgggcatggatatcactccggagcgtgaaaagcaggtgctgtttaccacgccgtactatgacaactctgccctgtttgtgggtcagcaaggcaaatacaccagtgttgatcagctgaaaggcaaaaaagtcggcgttcagaacgggacgacacaccagaagttcattatggataagcacccggaaatcaccaccgttccgtatgacagctaccagaacgcaaaactggatctgcaaaacggtcgtatcgacagcgtattcggtgacactgcagtggtcaccgagtggctgaaagacaacccgaaactggcggcagtgggcgataaagtgaccgataaagattatttcggtactggcctcggcatcgcggtacgtcagggcaacactgaactgcagcagaaactcaacactgcgctggaaaaagtgaagaaagatggcacttacgaaaccatctacaacaaatggttccagaagtaattcctgatgaatgaattttttcctttagcaagcgccgccgggatgaccgtcggccttgccgtttgtgcattgattgtcgggctggcgctggcgatgttctttgcggtatgggagtcggcaaaatggcgtcctgtcgcgtgggcaggttcagcgctggtaaccattctgcgtggcctgccagaaattctggtggtgctgtttatctattttggctcctcgcagctgctgctgacgctttcggatggcttcactatcaatcttgggttcgtgcagatcccggtgcagatggacattgagaacttcgacgttagcccgttcctttgtggtgtcatcgctctgtcgctgctgtatgccgcctatgcctcgcaaacgctgcgcggcgcgttgaaagcggtgccgatgggtcagtgggaatccggccaggcgctggggctgtcgaaatcggctatctttttccgtctggtgatgccgcagatgtggcgtcatgcgctgcctggcctcggtaaccagtggctggtgctgctgaaagataccgcgctggtcagtttgattagtgtgaatgatttaatgctacaaaccaaaagcattgctactcgtacccaggaaccgtttacctggtacattgtggcggcggcgatttacctggtgatcaccctgctcagtcagtacattctcaaacgcattgacctgcgcgcgacacgttttgagcggaggcctggctaatgtttgagtatttacccgaactgatgaaagggctgcacaccagcctgacgctaaccgttgcctcgctgattgtggcactgattctggcgttgatttttaccatcatcctgacgctgaaaacgccggtactggtgtggctggtgcggggttatatcacgctgtttaccggtacgccgctgctggtgcagatcttcctgatttattacgggccgggccagttcccgacgttgcaggagtatccggcactgtggcatttgctgtcagaaccgtggctgtgtgcgctgattgcgttgtcgctgaacagtgcagcgtataccacgcagctgttttacggtgccattcgtgcgatcccggaaggtcagtggcagtcctgtagcgccctgggaatgagcaaaaaagatacgctagcgatcctgctgccgtatgcctttaaacgctcgctctcttcttattccaacgaagtggtgctggtgttcaaaagtacctctctggcttacaccattacgctgatggaagtgatgggatacagccagttgttgtacggacgcacctacgatgtcatggtgttcggtgcggcagggattatttatctgattgttaacggtctgttgacgctgatgatgcgtctgatcgagcgcaaagcactggcattcgaacggcggaattaatgtagctgcgtgctgatgccggatgcgtcgtggacgtcttatccgacctgcatagtgcataaattcttataatgaagacggacaactcactaagttgtccgtctttttttatttcatttaaattatttaatcatatttattgcatataaattcacttaatggcattgttatcccatgccgcagacacggccaaaaatcataagattgacagacgggagttccatcatgaaaaagttagttcttgccgctttacttgcttcctttactttcggtgcttctgccgcagagaaaatcaattttggcgtttcagccacctatcccccctttgaatctataggtgctaataatgagattgtcggctttgatatcgacctggcaaaagccttgtgcaaacaaatgcaggcagaatgtacttttactaatcacgcgttcgacagcctgatcccgtcactgaaattcagaaaatatgacgccgtaatctccggtatggatatcacgccggagcgtagcaaacaggtatcgtttaccacgccctactatgaaaactcagccgtcgtgattgccaaaaaagatacctacaaaacgtttgccgatctgaaaggcaaacgtattgggatggaaaacggcaccacgcaccagaaatatattcaggatcagcacccggaagtgaaaactgtctcctatgacagttatcagaatgcctttatcgacctgaaaaatggtcgtattgatggggtatttggtgacacagcggtggtaaacgaatggctgaaaaccaatccacaactgggcgttgcgactgagaaagtgaccgatccgcagtacttcggcaccggcctgggtatcgctgtacgtccggataacaaagctctgctggaaaaactgaataatgcgctggcagcaattaaagctgacggtacatatcagaaaatcaatgaccagtggttcccgcagtaagtattcatttgccggagtgggtgttcgcccactccggcaacatcacctctctacgctaaccccaggcgctgaaactgctctggcggcgcatcattatctttcattaactggatcagcaacgcgatcatccgggcctcgatcgcatcatcatcaataggatgcaactgctgcggatcgttttgcagatcgaacagcaaatgcccaaactgattcagccccttatatttctcctgcgccgggatgcgtaacacctgtaaccctttggtaaaacgaaacggaggggccagcgataaagtccgcatctcatccaccggatagcggctgttcattttaatcggcattaatgtgtagttaacaatatcatcctcacgacccggcagcgcggcacgcatatacacataacgcccatcggttacgttgacatgaccactaaagacaccaaacatcgccgcgctgcgtaccggttcatcgtggctgaccgttttcgcaagtggttgcccctgcacatcgggcggcaccggctgctgaaaaaagtcatacagcgtaggtgcccagtcgatcatctgcaccaacgcctgacgacgttcgccttttacgccgctgcgcggatcccagataaacagcgggttattcgctacctcgttgtaataaggcatctggtttttcgcccaccagccatgctcaccgagtaaaaaaccgtgatcggtgccgacaatcagcatggtgtctcgccacagatcgtgctcatccatcaggtccagaatgcgccccaggttgcgatcgcacatcgacaccagcgagcgatagcggcagcggatatgctccacggcctcgtcgctttccagcacccgaccacgcggccagtcataatgcggcccgctccagtcatcctcatacaacgaaaggtactcttgcgttgtgtgaaacggctcgtgcggatcaaacgtttcgacctgcaataaccagttatcttccgcgtgatttttgtggataaaagcacaacccgcatcaaagactttggtttgtggaaaatccgcttcctgctgaatatattcccggttggcccagtcatgacgccacaggccagaaacaccgccgccggtctgcttttgtggcacccttagcacctcgggaataggcggttgcgcaacgctcgcctgccagtgatcgccttcctggccgcgcacaatctcccatgaactgtagcgattatgataattcccgccgccatcttcccagtaatgcaaatgatcgcttatcaggtgggtatagatccccgcctttttaagcagctccggcatggagtcgtcaaacggttctaacggcccccactcccggtgcaggaagttgcatcgcccggtatgcagctctcgccgggcgggcatgcagggcatactcccgacgtagctgttttcaaaggtggcggcatgtgccgccaggcgttggaagttctctgcttttgtcaataaatcgccatacgggggtaaatatcttttgttcaggctatcgaacaggagaataatggctttcattgctcatcccttttatttatttagcagatgagggaaatgctgctggacgacttcataaatctgcgcgccaatcgtttcaccatccataatattttcaatcggaatcagatattgcccgtgttttgggtccaggctgaccacgtcgagtaattttttggaaatagcaaaaatatccgcccaatcggtaaagcctcccacctcgcctgcggcggtatgttccatttcaactttgaactcatatttcgtcagcgcttttttaacaaccgtttgtaacatcacgctactaccgacaccataaccacagacaaacaaaatattaattgtatctttcatttttaaacccttaatagtgaattatcccgcgtaaggaccaagatggaatgttgcagcgataaatttcagaacttcacaaatagcaggccatacggttgcccagtcaaatattcctgtccagccgacgccattttcagcaagcccggttaaaggaatagcccacaccgtaccgaaggtctgaataatacccagcaagaaggtacagataattacggagcggtatccgcccattcggtttgctaatacaccaatcgggccgcctgagaaaaataaaggtacaaagcctggcaataccataatggggctgtggatcagcaataagatacccatcgagaaaatggtgccaaaagtacagaagacaaaacctaacgttgcggcattgggtgaaaaaggcaacagtgcggcgacatcgacggcgggaatggcgttaggaataaagcgatcctgccagcctttaaaagaaccgttaatttcaccgaccatcatgcgcacgccctgcaacagaatgaccatgtacatggagaactgtaagcccagattgatgatatagatgtaccagggtttacctttcgccatcatctggacgttatcaatgcccgtggagagcaggaaaccgcccacaaacagcgtcatcacaatggcgatagccgtcacgttgtggttaaaaatcgccagccagccgggaagtttcaggttttcagcatcgtgcttttccgggtcgccaaatttatgggcgaatttggagaaaaaccacaatcccaacatctggttatgggcaatagtaaaaccagcatctttagtcactttggcgataggtttaacaatgagcgtggtggaaaaagcccagaatatacccgttaataccccggcgataataatcgacgtggtccaactaaatcctaaccaaaaaacaattaaccataatacggcctgcgaatgtgacaccccagtattaccggtcaggaatatccctttggcaccggtatagcgaccaaacagtaccagtaacaggttggtaaaaaatgccagaacaaaaacataacctacgtaaccaaaattatcccccaacgcaatttgcgttgcggctttcatggcgtaggaatccattaaataaccatgaacgccataggctttacttacagcctctgctaccggtttaaatgttgcggagaattgaaacccaccaaataacaccatcattaatcccaccatggcgctgaccataccggtaataatttttattggcgatttcttatcaagggcataaccaatgcccaccagcaaaccaattaatattgcgggttcggttaaaaacgtttgaataacatctatgaatttggcaaacatcgtcggaacgccctccataagcgtacatttccgttgtcaatgcatgaaccttctgctgacgttaataatgcttcagatattttttatttttcgctaagcgatgcctctgcaggtattcggtaaacgcactttagtaatcaaaacagttcatttaaagatcttatttgattatttgtgatttgatttgcaaaaatagcgcaatatataaccatgatcgatcggttaatattaatcgatcgatcacggttattatttagaatggatgtatgccggagtgatattgatttgagtgatgtatttacatttttaccagcagtgtcagcacttcgtaatgcgcggtgtgggggaacatgtcgaaaagctgtacccgttcgatgcgataacccggcagctcgcggatatctttcgccatggtttgggcgttacagctggagtagatgataaaacgcggtgccatcgttgagagataatcacatagcggtttaccaatgccgcggcgcggcgggttaaccagcaccagctccggcacttccccctgggcggtagcaaactgagtggagtccagcgcctgaaattgcaaacgcgttaagcccagttcagcggctgactgcttcgcacaggcaatggcctctggtgcaatttcgatcccggttaactgcatgtcaggcgtcgcgcagtgtaaaccaaagccccccacgccgcagaacagatcccacatatggtttaccggtagttgccgcacccagtcgcgcgcggtagcgtaaagctggctggcgaccgccggattagtctggaagaaactttgcggacggatccacagcggcacatcgttaaaacgatccgccagcgcctgttgttcggtcaggtagatctccgtctccccttccataatcgccatatgtaccggctgaatattgacggtaataacttttagctgcggcagttgttcctgtaaccacggcagcgccttacgcagttgcgccagtttggtttcagaacgcagtacaaagcgcagcatcatgccgccatcgctctggctttcggtcagcagaatgtatttcagttcgccacgtttgcgcgccacgttgtaaggcgtaagcccggcgcgagcaataaatggtttcagtgccgcaaaaacgggcgcaaatgaggcaggataaagcgggcagtcacaaaggtcttccggtgtgccgtctcgatgcagcataccgagcagtggtttttcaacgctaccactcaccaccattttggctttattacgaaacccttgttccgggcctgacaccggcgcgcaccattcctcaaccggaaagtcggcgagcagatttttaagatcggcggttttagcggagagttgctctggaatcggctgcgttatccactgacaggaacgacagcgacccgcgtcgtaaagtgcgcactgcatacattgaccttcacatcatcaggggcgacgattatacacattattgcaactggaagaaccgccgactggtcgagggaacgaacagcagcatcaggatgagcatatccggcagcttctgcagcatcaggctatggaagatttcacgttttgattcaccgggaatgctgaacagctccggataaccataccccagcgaagccgcccacaagtaacttgcggccgtgatttgtgtcaacagatacagccagcgcgcccagcgacgccctttcaccagtgaaaacgcacaccagatctcaataaaaaccaacaccagactgcttaaaaagaccagcgttaaactccaggtttgtacgctgcgatgaatgaactcgccaataccgcgcacgcccagcgtattgaaaatcatcagcacgtcgaggccacggatcataataatggcgagcgccgccacctgcaccagcgcaggcacattcaggcgagcatgagatgaagatgttttcttaaaaaatcccaacgtttcgtcttccatgaaaacaatgccgcgacatgcgcggcattatgtagccaggttggcaaattttagtgtcttcagccacgtcttgcacgctggatgtcgcgtatccgctgtttttctgcgcgagccatcagataccaggcgataaatccgacaattccgaccgcaccgaggatcaatgttgccagggcgttgatttccggattcacccccatccgcacgctagaaaagaccagcatcggtaacgtggtggctcccggcccggaaacaaagctggcgataaccagatcatcaagcgacaaagtaaaagctagtaaccagccagaaatgatcgcgggcatgatcatcggtagcgtaatgacgaaaaacactttcagtggcgtcgcaccaagatccatcgctgcttcttctatcgagctatccagttcccgcagacgcgacgaaataacgactgccacataagccgtacagaaagtgacatgcgccagccagatggtgagcataccgcggtccgcaggccagccaatggcatgagcaagcgcgacgaataacaacaatagcgacaagcccgtgatgacatctggcatcaccagcggcgcggtgatcataaaggcaaaaccatttgatccgcgaaacttgccaaagcgcaccagcaccaccgccgcaatcgtcccgaggatcgccgccgccgtcgccgcacatgccgcaattgtcaggcttaaaccaaccgcactcatcatcgcgtcatcgcgcaataattcaccataccagcgcgttgaccagccggcccacaccgtcaccagcttcgagctgttaaacgaatagataaccagcatcagcattggcgcgtagagaaaggtgaagcccagcagcaaaatcacaatccgccagggcgaacgaactaccggtaaattattcatccgtgttctcccacgcttttttgctggtgtttgtggaaccacattatcggcacaattagcagcagcaacatgatgatcgctaccgccgaggccaccggccagtcgcggttgttaaagaactcctgccacagcacgcgcccgatcatgatgctgtccgggccaccgagcagttccgggatcacaaactcgcccacagccgggataaacaccagcatcgatccggcaataatcccgcctttggtcagcggcacgatcacagtaaagaacgttttcagcggtcttgcgccgagatccagtgccgcttccaccagcgaataatcaatacgaatcaaggcggtgtagatcggcagaaccataaacggcacgtaggcataaacaatgccgatataaacggccagattggtatgcagaatggtcagcggctggtcgataacccccagccacagcagaaaattattcagtacgccgttattttttaatattcccatccaggcataaacgcgaatcagaaacgaggtccacgacggcaggatcaccagtagcaataagatattacgggtcgaaggcttactgtgcgccaccgcccacgccagcggatagccgatcagtaaacagcaaatagtcgaaatcgccgccacctgtagcgactggagataagcatcgaaatagagcggatcgtcggtcagttgcaggaaattaccgagattaagagtgatggaaagttgcccgtcagcccactccatcagttcggtataaggtggaatggcgcgcgccatctccgccaggcttattttaaagacaatcagaaatggcagcagaaacagcaggattagccagatatagggcagcgcaatcaccagtttgcgcccatgcttcatttgcaactgcgacagccacagcttaaagggttttggctgggcagcaggttcaagtgtactcatctttgctccttaaaccgtcagcaccacacagctgtccacttcccagcacaaacgcacttcgtcgccccaggtcggtaaccctttacgatgacgatgggcgttttgtagctgggcgctgatcatctgcccacttttcagacgaacgtgatacaccgaaagatcgccgagataggctatgtgtatcacctcccccaccgcgaagttacaaccattggcgggcggctcttcgcaaagcatgattttttccggacgcagcgctacgtgtaccggcacgttatcaaccactgaagcatctgcatcgactttcagtgggtgcaccagtcccggcgaataaagcaccagaccatcttcctgacgctctttgagtacaccttcaaagacattaaccgagccaataaattcggcgctgtagcgggtggtcggatgctcatagatctcttccggttcgccaatctggacaaatttcccacgattcataatggcgatacgccccgccatggtcatcgcctcttcctgatcgtgggtgaccatcacacaagtcacaccgacacgctccagaatatccaccacttcaagctgcatccggtcacgcagctttttatccagcgcgcccatcggctcatcgagcagtaatagtttcgggcgcttggcaaggcttcgggccagggccacacgctgtcgctgaccaccggaaagctgatgcggtttgcgtttggcgaactcctgcatatgcaccagcccgagcatctcattgacccggctggcaatttccgctttcggtagtttgtcctgtttcaggccaaaagcgatgttctgttccacggtcatatgcggaaacagcgcgtaagactgaaacatcatattgatggggcgcaggtaaggcggaacctgtgacaaatcgacgccatcaagcattatctgtccggcagaaggttgttcgaaacctgccagcatacgcagcagcgtggacttgccacagccggatgcgcccagcagcgcgaagatttcacctttgtagatggtcaggctgacatcatccaccgcatgttgaccatcgtaggatttggtgaggttgcggatttctaatagcggcgtcagcgccttacgggttttcgcctgcgggcgagggatagcgtcattcacggctgctctccggcattgaatgtgtgcaagcgcaccataatggtgcgaattgccggcgggtgtggtgcgcccgtccggcatctacgactgcggattattttccgctcttcactttggtccacgcgcgggtgcgcacacggtctatttttggatcctgcactttcagagtgaacaacttcgcacgaacgtccgccggaggataaatccctggattatcacgcacttccgcgcttaccagcggcgtagcttctttgttcgcgttggcatagaacacatggtcggaaatatgcgccaccacatccgggcgcagcaggtaattcaggaactgataggcttcgtctttatttttggcatccgcaggcatggcgaagacatcaaagaacgccatcgccccttctttcggaatcgagaacgagacattaacgccatttttcgcttccttcgcgcggtttgacgcctgccagacatcgcccgcccagccaatagcgacgcagatatcgccgtttgccaggtcgttaatgtattgagatgaatggaaataacgaatgttcgggcgcagctttaacagcagatcggttgccggtccggtgtaatcatctgctttagtgctgttgggatctttaccgagataattcagcacggtagcaaacacttcttccggtgcatcaaggaaagagacgccgcagcttttcagtttttccagattttcaggcttgaggatcaagtcccagctatcgacgggcgcgttttcgcccagcaccgctttaactttatcaacgttatagccaatcccggtcgtcgcccacatatagggcatagcaaatttattgtcgggatcgtgtttggcaaccaacttcagcagctccggatcgagattcttccactccggcaatttgcttttgtccagcggctggaaaactcccgcagtcaactggcgttcaagaaagcttgctgacggcaccaccaggtcaaagccggtgctacccgccattaatttgccttccagtacttcgttagagtcgaaaacatcgtagacgactttaataccggtttctttttcaaaattggccaccgtgtccggggcgatataatcagaccagttataaatgtggagtgttttttgttcagccgcgagcgtgccgacagagacggccatcagagcacccgcaaccagacccgatagccattttttatttaaggcggtcatatctctttccttctgaaagttcgttaacaaacgaacaaaagttgtcacactgaaagatatgcaataaacgtgcatattttttatcggcgcggtgtaagaaaagagaactctctcccggccagcactgctcgctatataaaagcatcgcaagaataactttagccagggtttgagactatagctcggattaaaaaacggtatttaacaaatttttatgcgtatttgctctatgtgataaagccaaatcggcacatgagaagtgaaataatctttaagaaaaggttaaaaacagcagataattttgcagcacgcagtcactgcggcagcgactgcgtactcgaaaggagttatcagtggaggaaatagttttcggtaacgttgttttgcccttcatcgtcagtcggtaacagcagttgatgggcattagcttcaagaatgaccatcgaaatctgctcttcgctctgacgcacgaaccatgcaaactgctcataggttacgccctgcataacggataaagactggcaaaccaccagctttggcagattatcatcctgcatatcaagaaatgctttcacggtcagcgaactggcattgatggcagataaatctgccgccaggggcaatacggctgaaggtcggacttccgccatggcagaaaacaggatcgtgttatcgatcagatcgattttggcatcaaagacaccgtcgaaattctgcatatggggcagatgcagagcctgacagttatcacattcaaaaaaactcatccccaggtcatcgagccattgacgcagcgtatccagaccaggaacgaccagcgatgtcataattttgtacaacctctttcgataaaaagaccggcacagcttacgcaaaaagcgcaggcaaaaccatgatcagtaatgtgattgcgactaaccacccgttttcaggcaatattctgtcgtagcgtggcgttcgatccagcggatcattttacccgcgatgtcgataccggtggttttttctattccttccagccccggcgacgcattcacttccatcaccaacggcccgcgattagcacgcaaaatatctacaccagcaacatccagcgccatcgttcgcgcggcttttatcgcgatttcacgctcctgtggtgtgatactggcgacgcttgccgcgccgccacgatgcaaattggaacgaaaatcgccctctttcgcccgccgttcaatcgcagcgaccacttcatcgccaacaaccagacagcggatatcgcacccttgcgcctctttgatatattcctgcaccagaatatgcgcgttcagaccgcggaaagcgtcaatcacgctttcggccgcctgacgcgtctccgccagcacgacgccaattccctgcgtgccttcaaccaacttgaccaccagcggcgcaccaccgaccatgtcgattaaatcgctggtatcatccggcgaatgcgcaatgcccgtgacaggcaggtcgatgccctgacgcgccagcagttgcatggaacgcaatttgtcacgcgcccgggcaatggcgaccgactcattgagcggatagctccccagcatttcgaactggcgcagtgccgccgtcccataaaaggtaatggcggtaccaatacgcgggatcactgcgtcaaaatggggtaacttgcggcctttgtagtgaatagaagacgccgcaggatttatgttcatgtagcaagaaagcggatcaagaatttcaaccaggtgaccacgctgtatagcggcttcacgcagccgcttacacgaatagagcgttccatcccgggacaatatggcaattttcaccctgcacctctctgtcagacctggtcaaaagcccgcgtatcatacatcggcgtggcggttttagcgcgtcgcccaaccctgtttgtgcaaataatccagtataaatgggcggctttctttaatgattgttcggcggatatgatcgctccaggtatcccggcgattattgctgccacgtgtgaggtaatattccgccagttgttcgtcatactgcgccagtgcgtctttatccagcggttgatagctgttttcatgcaccaaaatggaggacggtaaacgcggcttaagatccggattatccgcaggccagccaaggcacagcccaaacagcggcagaacatgctgcggtaatttcagcagctccgtcaccgcttcaatattattgcgcaggccgccgatatataccccgcccaatcccagcgattccgctgcggttaatgcattctgcgccatcattgccgtatcaacgacaccgagcaacagttgttccgccaggccaagttgtgcatccggacagatctgtaaatggcggttaaagtcggcacagaacacccagaactccgccgcttgcgctacgtgtttttgcccgccggtcagcgtcaccagttcatcacgtaacgctttgtcggtaatgcgaataatgctactgcactgcaaaaaactggaactggacgtcgcacgggcgctgttaataatcgcctcacgctgcgcttcggaaatgggttcatcagtgaaatggcgaatggagcgatggccacaaataagttcaatggttggcgtcattatctttttctctttctgaacgtgaatattgcggtggacggttcatcagctgtggggcaagacgttttgccacctgaagaataaccaccaccgcagcgggaagcatgagcaaaacaccgagaaaaatcatcagaatctgcacttctggccgagaaaatggctcaggcagcgacagggagccgcttaccgacagcagcgccaccgccagcaacatcattccgataaattccagtatcaacacgcttttaggcaatttaccgatcgcgcgcatacgcttccctctgcaaagtgagccttcagtctaaaacttttcactgtattgtgtttaacagttatagcttttagcaattaatgcaacaggttaaacctactttcagcgaattcattttagcgtgatcattacaggcataaatctatgaggagagaaataatgcaaaccgttatttttggtcgtccgggttgcccttactgtgtgcgtgcaaaagatctggctgagaaattgagcaatgaacgcgatgattttcagtatcagtatgtagatattcgtgcggaagggatcactaaagaagatctacaacaaaaggcaggtaaacccgtagaaaccgtgccgcagatttttgtcgatcagcaacatatcggcggctataccgattttgctgcatgggtgaaagagaatctggacgcctgatcgtctgacaagccctcgcgttgagggctttattgattttttctgtgctgtggtttaaacaaactactgataaataagaaacacagtgcccccagcgcacaccagaacaccgcacttaataaccatgccagctcttgccagaatgagcgcgtcggtgaaaaaaacagccgcataataagcattgaacagggtgccgccagcattgcgccaaacagaggtttcaagacttctctacgctgtgaaaagaagctggcaactgctccaggaagaatgaaaaacagcaagccgatttcaggatgcccggcagcccgaaaagcgcctttcatgtgcgtcgccagaaaaaggcacaccacaatgaagaggacaaaacagcagattgcccccgcccaacgttgtttatgtttcactcgttcctcctgacactgcgtctatcgaacacatttttcgccagtgtggcgttcagtaagataaagccgcttcgcattccatgctaatataggccaacgcaattcatatagccgttgatacctaatgtgattacactagtaaaatatattgttactttactatcgtttaggtgcgctgaatgaatctgcgccctgaattctggtaaaaaacattatcgtaaattaccatttctttcaacagcttactagtaaacaagaagttagcctccgtgaatataaacgtcgccgaattgttaaatgggaattacattctgttattatttgtggtcctcgcgcttgggctatgtctcgggaaattacgacttggttcgatccaactgggtaattccattggcgttttagtcgtatcgctgttattaggccaacaacatttcagcattaacaccgacgcgcttaatcttggctttatgctgtttattttctgcgtcggggtcgaagccggaccgaactttttttccattttttttcgcgatgggaaaaattacctaatgttagcactggtgatggttggcagtgcgctggtgatcgccttagggttaggtaagctgtttggctgggatattggcctgacggccggtatgttagcaggctctatgacgtcaacaccggttttggtcggtgctggcgatacactgcgtcattccggcatggaaagcaggcagctctcactggcactggataatctgagcctcgggtatgccttaacctatttaatcggtctggtgagtttgattgttggtgcgcgttacttgccgaaattgcagcatcaggacttacagaccagcgcccagcaaatcgcccgcgaacgtggcctggacacagatgccaaccgtaaggtttatttgccggtgatccgcgcctaccgcgtcggcccggagctggtagcctggaccgacggcaaaaatctgcgtgaactgggtatttatcgacaaaccggctgctacattgaacgtattcggcgtaacgggattctggcaaatccagacggtgatgccgtgctacaaatgggcgatgaaatagcgttggtaggctaccccgacgcccacgcccgactcgatcccagcttccgtaacggcaaagaagttttcgatcgtgaccttctcgacatgcgtatcgtcactgaagaagtggtcgttaaaaaccataacgctgttggcaaacgcctggcacaactgaagttgaccgatcacggttgcttccttaaccgcgtcattcgtagccagattgagatgccgattgatgacaacgtcgtgcttaacaaaggtgacgttttacaagtcagcggcgatgcccgccgggtaaaaaccatcgccgatcgcatcggctttatctcgattcacagccaggtcactgacttgctggcattctgcgccttctttgttattgggctgatgatcgggatgatcaccttccagttcagcacattcagtttcggcatgggaaacgctgccgggttgttattcgccggaattatgctgggctttatgcgtgctaaccacccgaccttcggttacattccgcagggcgcattaagcatggtgaaggagttcggcttgatggtgtttatggcaggcgttggtctgagcgctggtagcggtattaataacggcctgggcgcgattggcggtcagatgttgattgccggattgattgtcagtctggtgccagtggttatctgcttcttgttcggtgcttatgtattgcgaatgaaccgcgcactgttgttcggcgcaatgatgggcgcacgcacctgcgcgccggcaatggagatcatcagtgatacagctcgcagtaatatcccggcgctgggctatgcgggcacttacgcaatcgccaacgtcctgctgacgctggcagggacaatcatcgtcatggtatggccaggattaggataaaactgaagttgccctgaaaatgaaatttttttgcacaaccgcagaacttttccgcagggcatcagtcttaattagtgccactgcttttctttgatgtccccattttgtggagcccatcaaccccgccatttcggttcaaggttggtgggttttttgttgcctataatttatctactaccctgcaaccctctcaaccatcctcaaaatctcctcgcgcgatagcggcttacggtcggtgacaaaatgcagcgtcatcccctcaataaacgcatcaagcgcgcgggcggttccgggttcaaaccattgttcgagcgtttgctgactgcgctgcatccagttttgcattaccgtttttaatagcggttttcggctagccagcgcgtagagctggtacatcagctccatgttatccggcgttgcaacctgtgagctgtagatcatatcggtgatagcctggcatgcgccttgagcatcactaacatcgctaaaaaatgcctgatattgccgggacatgatctcagtaaaactgctgaacgcctccagcaacaactcatcaattcctgaaaaatagtaggtcatcgaccccaacggtaccccggcaagggtagcaattttgcggtgcgtaacagcatgtattccgtaaagtttcaccgcctccagcgtggcctggataattttttctcgccgttgcggatcgttagcgcgacgcatgtcatttcctctctctgcaattgtgtacaaatgtacacaaccttgctaatgttgtcttccctcttcttattttgacgtgatctatgaccgtaaattcttcacgtaatgcattgaaacgccgaacctgggcgctgtttatgttcttctttttgccgggcctgttaatggcgtcctgggcaacccgtacgcctgctatccgcgatattctttctgtttcgatcgctgaaatgggcggagtcctctttggtctgtcgatcggttcaatgagcggtattctctgctcggcgtggttagtgaaacgctttgggacgcgtaatgtcatcctggtcacgatgtcctgcgcattgatcgggatgatgatactaagtctggcactctggctgacatcgcccctgctcttcgcggttggcctcggcgtctttggggcaagttttggttctgcggaagtggcgataaacgttgaaggtgctgccgttgagcgagaaatgaataagacggttttgccgatgatgcacggtttttatagcctgggcacgctggcaggcgctggtgtcgggatggcactgacggcctttggcgttccggcaacggtgcacattttattggcggcgctggtaggcatcgcgcctatttatatcgccattcaggcaatccctgacggtacgggcaaaaatgctgccgatggcacccagcatggtgaaaaaggcgtacctttttatcgcgatatccagttgctgctgattggtgttgtggtgctggcgatggcctttgccgaaggttctgccaacgactggttacccttattaatggttgacggtcacggttttagccctacttccggctcgctgatttatgccggttttaccctggggatgactgttggacgctttaccggcggttggttcatcgaccgttacagtcgcgttgccgtggttcgggccagtgcactaatgggagcgttgggtattgggctgattatttttgtcgatagcgcctgggtcgctggggtgtctgttgtactttggggactgggtgcctcgctgggcttcccgctgaccatttctgccgccagcgataccggccccgatgcaccaacccgcgtcagtgtggtagcaacgaccggttatctggctttcctcgtcgggccgccactgctgggctatctcggcgaacattatggattacgtagtgcaatgctggttgtactggcgctggttattctcgcggctattgtcgcgaaagccgtcgccaaacccgataccaaaacgcagacggcgatggagaatagttgatgagcattaaattaattgcggtagacatggatggtactttcttaagcgatcaaaaaacctataaccgtgagcggtttatggctcagtatcagcaaatgaaagcacaaggcattcgctttgtggtcgccagcgggaatcaatattatcagttgatctctttctttccggaaattgctaatgaaatagcctttgtggctgaaaacggcggctgggtagtgagcgaaggcaaagatgtttttaatggcgagctgtcgaaggatgcgtttgctactgtcgtggaacatttgctgacgcgcccggaagtggaaattattgcctgcggaaaaaatagcgcctataccctcaaaaaatatgacgatgccatgaaaacggtggcggaaatgtattatcaccgtctggaatacgtcgataactttgacaacttagaagatatcttctttaagtttggtctgaatctttccgatgaactgattccacaagtacaaaaagcattacatgaggccatcggcgatattatggtgccggtccacaccggcaacggcagtatcgatctgattatccccggcgtacataaagccaatggccttcgccaactgcagaaattatggggaatagacgacagcgaagtggtggtctttggcgatggcggtaacgatattgagatgctgcgtcaggcaggctttagttttgcaatggaaaatgccggcagcgcggtcgtcgcagcggcaaaataccgggcaggctccaataaccgtgaaggcgtactggatgtgatcgataaagtgcttaaacacgaagcgccatttaaccaataaaacggcagcacgcccggcaacacaatacctgaatgaaggctgcataattcgcgcaaattaacccgctgcattatttcaggcgaaatgattatgaaaaattgtctactgttgggcgcgcttttaatgggctttactggtgtggcgatggcgcaaagtgtcaccgtcgatgtgccgagtggatacaaagtggttgtggttcctgattcagtcagcgttccacaagcggtcagcgtcgcgactgtgccgcaaaccgtctatgtggctcccgcgccagctccggcttaccgcccgcatccttatgttcgccatcttgccagcgtaggtgaagggatggttatcgaacaccagattgacgaccatcaccattaatttgagaatgcctgatcgcacaaagcaatcaggcatttttttatccttcgtgcgaatttcccatctgtttatcttttaaaaagataaccatcagcaacagccacaaaattccgttgacaaggttgaagagattaaacagtccgttgcccccgttcagccaggcatgtttgctgatttcaataccgacggtaaagatcagcatttgcagcatccccatcgccgcagaaaccgtacctttactcatatcgctggcaaacagagttaatcgcaccagtcccgcattcgccagaccaataccgaaagcataaagacttaacccggcggccatccataaatacgcatgcgatgagataaccgttgccgcagcagcgaccaacagaccaatcataatcggccagccgcccataataatcagcgaacgtacggtgcggcgcgaggtcagacgcgctaacagcaagttacccgcaattaacgccccgaaaataggcacttgcagcaaaccatattcatagctgcttaactgctcgccggtaatgatgataatcggcgactgggcgatccacgccagcaacggcaaactaacgaatcccagcgccagcgcccccgcaacaaagcgaccgttcttcagcaccagcttatagtcacgaccgagttctttcagcgacagtttctcgcctatacgcgtggcggtttcaggcatggctcgttgcagaccgaaaaaggagatcgctgccaatgcggcaaacaagacaaacatcccttcccagggcagcacatggatccacgccgcgcccaccagcgggccaagtagtggagcaatcagcgccacgttcgccatcagcgcggtgatcttgatacaaaccgcctcttcgaaggattcctgaattgcggcgtatcccacagcgccaatgaaacagaggcttatgccctgcaagaagcgcaacagagtgaattgttcaatgttttgcgccagtaatattgccagacaggtgatgataaaccacaccacccccgccagcatcaccggacggcgaccaatacgatccgacagcggccccaggagccattgtaaaaacatcccgcccgccagatatgcggtcatcgaagtaggaacccaatcaatgcccgcctgatattgttccaccacggccaacataccgggttgaatcatatcgttgccgatataggttgaaaattcgtacagcaccagacagagagggaaaagtaacgcctgacgtccaagcctggcaccggaagctaatttattttgcatgcaatttcttcgccaataataatcgcgcaaagtttaataaaagcgcagctaacgagaaagcgaattttgtagctgaaaccacggttaagcacattcttacattattgcgagtatagctacgctttctttaagttttatttaacctatgcccgttacaatcacccaccgtaaacaggccgcttgagggaaataagacgatgccgctttacccagtttaacctgcactttattctcaacgacttgcctgtattggctcccttttaatcactttgcgtcgggaagttatgctggaaaatttgaatctctctctattctctcttattaacgcgacgccagactcggctccgtggatgatctcgttggcgatttttattgctaaagatttgattaccgtggtgccgttgctggccgcgatactttggttgtgggggcttacagcacaacggcaactggtgataaaaatcgctattgcgctggcggtcagcctgtttgtgtcctggacgatgggacatctttttccgcacgaccgcccctttgtcgaaaatatcggctataacttcctgcatcatgcggcggatgactcattcccgagcgatcacggtacggtgattttcacctttgcactggcatttttatgctggcatcgcctgtggtccggctcacttttaatggtgctggccgtcgtcattgcctggtcgcgcgtttatcttggcgtccactggccgctggatatgctcggtggattgctggcaggtatgattggctgccttagcgcccagattatctggcaagcgatggggcataaactctatcaacgtctgcaatcgtggtatcgcttctgttttgcattaccgatccgcaaaggctgggtgcgtgactgatctctgctaaaaagtgtagtattgagcggctcgcttcaataactattcagagggattatggaaacacgtcgcgaagagcgtatcgggcagctgctgcaagaattaaaacgcagcgataagttacatcttaaagacgccgccgccctgcttggggtttcggagatgacgattcgtcgcgatctgaacaaccacagtgcgcccgtcgttttgctcggcggctatattgttctggaaccgcgcagtgccagccattatctgttaagcgatcaaaaatcccgcctggtggaagaaaaacgccgggcggcaaaactggctgcgacgctggtagaacccgatcagaccctcttttttgactgtggcaccaccacaccgtggattattgaagcgattgataatgaaatccctttcaccgccgtttgttattcgctaaatacctttctggcactgaaagagaaacctcattgccgcgcgtttctttgcggtggtgaatttcacgccagcaacgccattttcaaacccatcgattttcagcaaacgctgaataatttttgcccggatatcgctttttattccgcggcgggggtgcatgtcagtaagggcgctacctgttttaatcttgaagagttgccggtaaaacactgggccatgtcgatggcgcaaaagcatgtgctggttgtcgaccacagtaaatttggcaaggtgcgtccggcgcgcatgggtgacctgaaacgctttgatattatggtaagcgattgttgcccggaagatgaatatgtgaagtacgcgcagacgcagcgtattaagttgatgtattaatgacgtataaccggatgacgtttcgcgccatccggttatcagaagattaagagaaccagctgccgaaccactgatggaatttcatcatcacgaaatcccacatccgaccaaagaatcccccctcttccacattttccatcacgatcagcggacgctgctcaatggatttaccgttaagctggaaatcaatggtgccgacaacctgaccttttttcagcggtgcggtaagctgcggttccgttaacgtgtagctcgctttcaggtttttcagctgcccacgcggtatggtcactgagcccgcttcgcctgccccgagattcacttcgctcttatcaccaaaccagacgcgctgagtcacaaaggtggcatcaggtttaattggcgtcacggtttcaaagaagcggaaaccccaggtcaataatttctcagactcattaaaacggatacggtcagttttcgcacccagtactacggagatcaaacgcatatcgccctgggtagccgaagcaaccagattatatcccgcgcctgccgtggttcctgtcttcatgccatcaacattcagattgctgctccatagcagacggttacggttaggctgtcgaattttgttgaaggtgaactctttctctttatgaatggcatactcttccggcacatcgtggatcaatgctttacccagcaatgccatatcgcgcgcggtactgaactgccccggcgcatccagaccgtgcaccgtctggaaggtagtgttggtcagacccagttttttggcataaccattcatcagaccaataaatgactcctggctcccggcaacgtaatcggccagcgcaatacaggcgtcattaccggactggataatcacacctttgttcaggtctgccaccgaaacctgatcgcccggtttaaggaacattaccgatgaaccacgcagtgccggatttcccgtcgcccaggcatctttaccgaccgtcaccatatcggtgagtttaatcttatcggccttaagcgcctgcccaaccacatagctggtcatgattttagtcaggctcgcggggtccagtttttcatccgcattgccttctgccagcactttaccgctggcgtaatccattaaaatccatgcacgcgcatccacgctcggcgcttcaacggtttgttccgccgcgaatgccgttggggcaaaaaggaataaaaatgcagaacccgctgcaagaccacgaaggagagaggagtattgcgtcataaatgccacccgagtatccattcaaaaaaaatacgttatatcgccgtatgataagttcggtgattaataacgcacacacaaacttaaagaaaccgtaagttggtaaagtttttaaagtttatgcaatatcctgccgcttcgctgcttctggtgtcatttttttgccagctgttgcttaaaagttaactttacttcaccatcggagtcctgttcagcctgtggctgcctgtcggaaaaggggtgagtatgattacgctgtggggtcggaataattcaaccaacgtaaaaaaagtattgctgacgctcgaagaactggaactaccttatgagcaaattctcgcgggccgtgagtttgggataaatcacgatgctgattttctggcgatgaaccctaacgggctggtgccgttgttgcgtgacgacgaaagtgatctcattctttgggaatcaaacgccattgtccgctatctggcggcacagtacgggcaaaaacgcctgtggatcgactcaccggcacgtcgtgcggaagcagaaaaatggatggactgggcaaaccagacgctcagtaatgcccatcgcgggatcctgatgggattagtcagaacaccaccggaagagcgcgatcaggccgccattgatgccagttgtaaagagtgcgacgccctgtttgccctgctcgatgcggaactggcaaaagtaaaatggttctccggcgacgagtttggtgtgggcgatatcgctatcgcaccgttcatctacaatttgtttaacgttggcctgacctggacaccgcgtccaaatctgcaacgctggtatcagcaactcactgaacgcccagcagtgcgcaaagtggtgatgattcccgttagctaattgcgtgggctaactttaagtaattccccactggactcgtcggtgagaacgtataaataaccgtcgggtccagtgcgaacatcacgaattcgctgccctctgtccgttaaaatacggccatcttctgtcactttgtcgccgttgacgctcatcacaatgacatctttatctttcagcgcgccaataaataatttttgctgccactgggggaatttatcgctgttatagaaggccatgccgctcacggcgggcgaatctttccagtaaaaaacaggttgctcggtcccggcgacgatctcccctttcgcttccggtatcttaaagcccgaatagttgattccccaggttgccagcggccagccgtagtttttgcctttttgcgggatattaatttcatcaccaccgcgcgggccatgttcattcagccacagtgcattactccacggattcatcgccattccttgcggattacgaatgccataagaccagatctcggcgcgcacaccggattcctttataaaaggattatcatccgggatttcgcccaggtcggtcagacgcaccagtttgccctgtaatttatccagatcctgcgccgtcgagcgctgattgttttcgcccagagcaacaaaaagataacctttaccgtcgaataccagccgcccgccaaaatggttgccggtagacagttttggcatctggcgaaagacggtgcggaagtcggtcacttttgagagatcatcacttaagcggccataacccacagcagttccggctttgccatcatcgccaacttcggaataacttaaccagatgcggcgagactgagcaaaatcaggcgctaaaaccacgtccagcaggccgccctgcccgtgcgcccaaacgtccggcactccggaaagcggcgcagataatccttttcctgcttgccagtgacgcaactcgccgccgcgcagagtgattaacataccgtgattatcgggtaaaaaggccagcgcccagggatggtcgagtttgtcttgcagtacttcgacatttaccgttgcaggagccgcccagagagcggaagaaagacaaataaggggcacaaggaaaaaggattgtcgatgcataacgcctccggattgactctggcttaaagcgtagtcagtggaggagataacaaattcatttttacaaaaacttaaacatgaagggggagacgctttctcccccttagtttttaggccttctcaagcatggcgtgcttctgcaggctctggatactcagcgttaagctcatcagacaattttcaagcttatcggcgttgacggtaataacagtcgggcaatcatggtgcccactcatcaaacatactgcggctgtcgctaatgcttcttcagcatgatgaagagcactccactcttcctgatccagatgaagattcaaccgcagcgatttatcgtgcagttcgcgattcagtttaaaaaagttatctcgtagatgattgctttcgctgacggacatgtatccttttgccttcctcagttgcacgtatgcggcgaggtcaacgcgtgcgtcgatcaaccggttcagcagatcgattcgctgtctgtcaacgaacatacttcgatcctcctctttccagccttgttgcaattaaatagtatggctattttttgagcaaaatgctgtccaggatcaattcttcacgccgaattaacaaaatttacatttccttcgcctccgccagcgaatgagattgcgatacaaattttatccagaactctgtagaatccctgccctgacctttcctgtaactgaatattttttaagctatgagcaaagtaactccccagccgaaaatcggctttgtttcccttggctgtccgaaaaaccttgtcgattcagagcgtattctcaccgaactacgcactgaaggttatgacgtggtaccgagctatgacgatgcggacatggtgatcgtcaacacctgcggctttattgacagcgcggtacaagaatcactggaagccattggtgaagcgttgaatgaaaacggcaaggtaattgtgaccggttgtctgggggcaaaagaagatcagatccgcgaagtccacccgaaagtgctggaaatcaccgggcctcatagctatgagcaggttctggagcacgttcatcactacgtgccaaaaccgaaacacaacccattcctgagcctggtgccagaacaaggcgtgaaactgacgccgcgtcattatgcctatctgaaaatttctgaaggctgtaatcaccgctgcaccttctgcattattccgtctatgcgcggcgacctggtgagccgtccgattggcgaagtgttaagtgaagcgaaacgtctggttgatgcgggcgttaaagagattctggtgatctcgcaggatacttccgcctatggcgtcgatgttaaacatcgtactggcttccacaacggcgagccggtaaaaaccagcatggtcagcctgtgcgaacagttatcgaaactggggatctggacacgtctgcactacgtttacccttatccgcatgtggacgacgtcatcccactgatggcagaaggcaaaatcctgccgtatctggacattccgttgcagcacgccagcccgcgcattctcaaactgatgaagcgtccgggttctgtagatcgccaactcgcgcgcatcaaacagtggcgcgaaatctgcccggaactgaccctacgctcaacctttattgtcggcttccctggcgagacagaagaagatttccagatgctactcgacttcctgaaagaagcgcgtctggatcgcgttggctgctttaaatacagcccggttgaaggtgcagacgccaatgccctgcctgaccaggttccggaagaagtgaaagaagaacgctggaaccgtttcatgcagttgcagcagcagatttccgccgagcgcctgcaagagaaagtgggccgtgaaattctggtgattatcgacgaagtggacgaagaaggtgcgattggtcgcagcatggcagatgcaccggaaatcgacggcgcggtttatctcaatggtgaaaccaacgttaagccgggtgatatcctgcgtgtgaaagtcgagcacgccgatgagtacgatttgtggggtagccgggtttaattaatcttaaggcagatctaacaagaatattgttcttcgatctgcctctgctacccttccctatgtcctacccttacgcacaaaatcccctgacgcataaatcgagaaaaatgaatcgtactcgaggcaactctcactttttcacaccaaattaaagttttgatcgcaattacttgaaataagcgtaatggttactatagtaaacattaccacaaggatggatgtatgggtgtgtataaggcaagacgattcagccaaagcacgaaaaaacttggtattcacgataaagttctcatggctgccgctgaagaagtgatgcagggcatatgggaggctgatttaggtagcggtgtcatcaaaaaacgtttacccctccaacaaggaaagagtggtggagccagaacaattatcttttttaaatcagcaaatcatgtgtttttttatgatggttggtccaagagtggtctaagcagtaaaggaaccaaagaaatcgaagatgatgaactggcggcctacaaaaaaatggcaaatgcatttctggcctttagcaataagcaaatagaggatttgatcgaaactggctttttgattgaggtgaaaaatgagcgataaattacaaatgatgctggaagatgcaaaggaactgaatgcactgggcctgatgtctgatagtgaagttgatgccattgccgtcatggtcaaagctcgtgaagtcagcgcccgtatagccaaagtcaaatcaatgacgggtgaagagatcaaagccatccgcacccgatacggcatgtcacaatccgtgctggcacatacaatgggaatgtcaaaagaaagtgtctcgaaatgggaacgaaatgaaataaaaccgagcggcccggcactacgtattttgaatacattggcaataaaaggaccggaagtttttgcaaagtaaaatgtttgcaaatgatttaccacattcattagtaccccttgattaaggggtactaacactattctaattctactgccagctaatctgcgccctgccgtttttcttactcttatacagccgctcatccgccagcattttcaagcgttcgacggtagtacattcatttgaatgcgctacaccgatactggtgcttaaattaatgcttcccacctggaaatgaacgatttcttttagaatcgatagcaactcttccagcgttccacccgtataaatcaccgcaaattcgtcaccgccgaagcggtagactttacctttatctaccgggatctgtgatttaaggattttcaccactttcatcaacacttcatcgcccagcaaatgaccgaaggtgtcgttgatgtttttgaatttatcgacgtcaaacaggcacaaataaccacctttttccggtagcgcttttaaatcttcgtcaaaggattttctgcccatcgctttagtcaggtcgtccaggaacgccgagttatacatactgtagagttttttgacatcggcagccgaaaagaaaagcccgccatctagtacgcgttcaaaatggttattaataatggcttctttctccacaataccacgattaatcactctgcgtaccagatagaggcaactggcacccgatatcactgccaccaatgcggcaaagaaaataatcaacgtacaaacccgcaaataaacatcttttttatacgcaaatacgtacaatccggtcggcaaataggagaagtgctccatcgcttccgaaacggtgaagatggcgtttttagcattatattcatcaccggtcaccggtttaccgttcttaaacagagagaacatcaggttctcgctatccatcgccagcgattttgacagtaaagaaaaacgctccagaccaagcaaaaatatcagactgcgattgtgagttaccggatagaggtaatagacgaaagttttaccgtcaaaagagataaaccctgtatttttgacatgtcgatacttcacaacctgcataatatctgcacaataatttttctcgaactcctttacctgaatacattcgtcactggaaatcagataaggaccgacatcgtacaaataagagggtgaaaccgagtcggcgtaagctgtgcgcaagccaaccaacagctgttcctccgtggggtttagcgtgttgatgagatcaattgccacgctacgccgatattcagcaatatttgccaccgcaaaagcagtatcaataacggactgtttcaggccatacacccgttcctttaccatttgagtgtagatcccgcaggcaactgctgaaatcatgataaaaatcagcagactgactgtaagtacgaacttattgattctggacatacgtaaactactcttttactaattttccacttttatcccaggcggagaatggcatgggtttctggtacagatacccctgagcctgaacacatcctaatttgattaattcgcgcgcaacatcttcgctctctacgccttccgcaatcaccggaatccggttatagcgtgccagatcgaaaataatgcgcacaatttttcccgcagtaccgaaaatatcgccggtaaattgcgagtccacttttatgctatctggattaatttcataaaaacgtttcaggtttgacaaaccggtgccaaagtcatcaatcgatatccgtaccccttgtttacgcagttgttcaatattgagataaaaatgttcattaattcgctcgatcacggtttcagtgatctcaacacagaggctgttcgccttcagaccgttttctttcatgatggtggtaaaacgctcatgaaagtgtggttcgtttaactgccagggcgaaacattaatatgcagtaagaaaccgtccttcagaaccgcacgctcgctaaaatgcctgaattcacccattgccattttaataatctgataacccagctcattgataaacccgatatcttcagcaatggtaatgaactttagcggtgaaatgatcccccgctccgcagacacccaacggcacaacgcctccgcgcccagaatggtgcgggtgttaatatcaacgatcggctgatagaccaggaatagttcgccaatttccattgcatggcgaatattacgcgcaatccagatattctcttctatttcgttgagtttcgcgtcatcacagaaaataaactctgagaacatatggtcacgaatgctggaaatcgccagtttcagtttttctgcgtaactccaggcgttttccccctgcaaaggttcacaaatggcagacttatggatgcgcagattgcggtagccaaagctgctgtcaaaatcgtttaccatcgctattttacgggtaaatgtctgtacattttcccggcacagaagtaaatagagatcggcattaaatgtcacgatatcgcagcattgcgcatatttctcggcaattcgctgacacaatttcctgacgattttattgcgttcatcaacaccaaacaccgcttccacggcttccagaccacacagtttgatgatccccacagccagatactgattattgttggactcaataatcgccatatttttaataaaaccgctttcctgatcgtaagagatcagtgagagcaatttatttgaccgttcaatttcggcatctttcatttccgcgatcgattttttgatgctgataatctctttcgcatcgccttcgcgaattttcagagcctcgatttgatccgttgagtcaggcaaaaacgccagcgtattaaccagctctgtcatttcagaaaattgccgacggaacacacgagtggtcattaaataaaccaccagcaatacgataataatgaaagcaaacggcagataaaaaagtttatctgatgcgttcaataaattaccgccaggataataaaaatagatttcgaataatgcgttgtttggcaccgctgatgttttttcgatatattcagtatcgacagaatcaataatattataattaccttcgctattataaataatcagtttttcacgcgcgagttgattcttggcaatgatctcatggccttgtttcaaaaatagaacttcatcattagcgctgatttgatcaagatactcgttcagatatcgccagtttaaatcgacatgaattttatccaccgctaacaaatcgtgatctttgccgttgatgtgtagcgtaaaagagatacattttttacccggacgatcaaagcaattgtatgccggattccagctgttgttagagtcatctgaagccaccgaccacggtcgtttcgatgggttaaaatcggcaaaaataacccgccctgactcgtcgacaagcggtccatttacttgttcctgatgataaactacgattttatcattcgccctccgcgaaaagagataatatttattatcatcaagtaccagtcccaccgagtctaaaaatggcatcatttccattttaagaatcacggcgcgttgaatctcctctgtattttttaataaatacagtgagtcctttaatgtcagggccgaacgttcaatatctttaaagaaatagccaacgtttttctgaataagttcaaagcggctatcggcacgttttaccgcgcgctccgataccagttgatagttaatgatgaaaaaaagaccaataaatgacagtgctgccaataaaaataaaattatcagccttatctttatcttttcgtataaactcagcatgttaatacatttaacaaaataactatctgaacgctgtgccgctgcaaaaattgtcccttgctgcggctttttaaccaaattacccgattctacaaaatcagcagaaagttacaacacttgcttagggcaataatttcctgtgaggtgattaccctttcaagcaatattcaaacgtaactatcctttaattttcggatccagcgcatcgcgtaaaccatcacccaacaaattgaacgccagtacagtcagaaaaatagccagggccggaaaaatagcgacatgcggcgcgataaccatatccgctcgtgcctcattgagcattgctccccactctggtgtcggcggctgcgcaccgaggccgagaaatgacaggctggcggcagagataatcgaggtaccgatgcgcatggtgaaaaacaccacgatagacgagacagtcccgggcaagatatggcgcaataagatggtcatgtcgctggcaccaatactgcgcgccgattcaataaaagtttgctgtttcaacaccagcgtgttgccgcgcaccagtcgggcaaacgcggggatggaaaaaatggcgactgcaataatcacgttagcaatgccgcttcccaacaccgcaacaacagcgatcgccagtaaaataccagggaaggcaaacagcacatcgcaaatgcgcatgatcagccgatcccaccagccttcataatatccagccaacaagcccagcaacgtcccgatcgccgcaccgataaacacggcaaacacgcccgccgccagcgagatttgtgcaccaaccaggacacggctgaaaatgtcacgccccagtgaatcaacgccaaaccagtgctgcaaagaaggtccgttattcagattgtcataatcaaaataattttcggcgtcatagggagcgatccagcgtgcaaaaatagccaccacaatcaataaaataacgaacaatgcggcggtcatcgccatatgctgacggcgaaatcgtcgccagaattcatgccacggtgtacgtacctggtcaggtttgaccagtggcatggcgtttaacaccgcctgacgtcgccagttaaatagtcgcatccttacttgtacctgatagccgggttaatggcggcgtaaagcacatccaccactaagttgataagaataaattccagcgagaaaagcagaatttccgcctgaatcaccgggtaatcgcgcatttctacggagtcaacgagtaagcgtccaagtccgggccagttgaaaaccttctccaccacgatggaaccaccgagcaaaaagccaaactgtaagcccatcatggtcacaaccgggatcatcgcgttacgtagcccgtgtttgaggacaacccaggtttcgctcacccctttcgccctcgcggtacgcatataatcttcgcttaaaacatcgacaaacgacgcgcgggtaaagcgcgccatcacggctgccactgccgcgccgagcgtcagggagggtaaaatgtagtgctgccaactgtctgctcccacggtaggcagccagcccagttcaacggagaatacctgaattaaaagcatccccagagcaaatgccggaaacgagatccccgacaccgcaatggtcatactcaatcgatccggccaacgattacgccagacggcggcgataattcccgccgccataccaaatatcaccgcccagaccatactggttatggtcagccacagcgttggcataaagcggctggcaatctcatcggcaaccggacgacgcgacaccatcgacaggccaaaatccccctgcacagcattgctgatatagtgccagaactggtgatacagcggctgatccaaccccagctgctgacgcaccagttctataacctgcgcatcagcttcgggcccggcaatcaatcgcgccggatcgccgggcagcatatgcacaaataaaaacaccagcaccgagacgataaacagcgttggaatcaaccccagtaagcgtttgataacgtaattaagcattccactccctgcgttgcttattgcaaatccgcgtcttcaaagctgaaaccggtgtctggcatgatccaaaaaccggtcaggtttttactgtgtgccgacaccagtttttctaccaccagcgggatccacggcgactcttgccagatgatatcctgcgccgccttatataaacgggtcttttctgccggatcattagttttcagtgcctgagccaggaagtcatccacctgtttattgctgtaaaacgcggtattaaacagcgtcggtggccagttctgcgaggcaaacagcggcgatagtgcccagtccgcttcgccggttgaagccgaccagccagtgtagaacatccgcacgccgctctctttttgccctttaccttcaacttctgccgcccgctgtccggcatccatcgcagtcacctgggctttaatcccgacctgcgctaactgctgctgggtaaattgcagcactttctgcgcggtgctgtggttatgtgacgaccacagcgtggtattgaaaccgttgggatatcccgcctctttcagtaattcgcgcgctttcactggatcgtaaggccacggtttatagctttgcgcgtaggcgatactcggcggtaccacaccagtagctggcgttgcatagcccgcgaaggccactttcaccagcgccgggcggttaatggcgtaattcagcgcctcacggaccttcgggttatcgaacggcttttgcgtcacgttcatactgatataacgctgcataattgacggactggccatcaactcgatatttttgtttttctccagcagtgcggcctgctcgtaaggaatggggaaagcaaactgcgcttcaccggtttgcagcattgccgcgcgggtgttgttatccgccaccggacgccaggttatgctgtccagtttgggcaatcctggctgccagtaacccgcgaattttttcaccttcacaaaatcggtctgattccaggtatccagttcatacggcccggttcccaccggatgaaaaccaatctccttgccatatttttccagcgctgccggcgaaatcatcgcggtcgccggatgggcaagaatattaataaacgctgagaacggctgtttgagggtaatctttaccgttgttggatcgatcgcttccgttttggcaatattcttatacaggttgtagcgtttaagatgattcgccggatcgctggcccggtccagattcgcttttaccgccgctgcgttgaagtcggtgccatcctggaatttaattccttcccgcaatttcacggtgtaagtaaggccgtcatcggaaacggtataactctccgccagcacgtttttcagtttcatctctttatcgagaccgaacagcccctggtaaaacgatttcgctacggcctgagataacgtgtcatttgcgtcatacggatcgagcgtggtgaagttcgatcctaccgccaccaccacatctttggcagcgaatgcacaagatgccatcaacgctgtcgcaatgcccagcgccactaacccactacggtgtacagctcttgccattttattctccgcctgaatgttatctacgcatgaatgcgtattctgattgtggttgtgcgacgtaatgccccggcccgacgcattgcaacgagacggctgccacctcttcgccacgcagatgaatattgctgggaagatcgtccgacagcagtacacgctgcggtcgttgtcgggacggttcagcgaccggaactgccgccagtaatttacgcgtataaggatgcttcgggttttcaaagaccgcgcgccgtggaccaatttcaacaatttgtccgagatacatcaccgccacacgatgactaatccgctctaccacggccatatcgtgggagataaacagatacgcaatgccgaaatcacgctggagatcgagcaacaagttgataatctgcccgcgaatagaaacatccagcgccgagacggcttcgtcggcaatgatcacttttggattcaatgccaacgcgcgagcaatgcagatgcgctggcgctgaccgccggaaaactcatgcgggtaacgccaggcatgttcaggtaacaggcccacgcgctccagcaaccacgcaacgcgtgcagccgcttctttacctggcaataaaccgtgtacgcgcagcggttcgataatcgaatcaccgatggtctgacgagggtccagcgaagcgtaagggtcctgaaaaataaactgaatatcccggcgcaatgcctgaagtttaccggatgacaaggtatcgattcgctgaccgttaaagataatttcgccgccctgcgattcgaccaggcgcagcaacgcccgcccggtagtggatttaccgctgccagactcgcccaccagcgatagcgtttcgccaggccagagatcaaaactgactttctcaacggcatgcacttcccgcgttacgcgattcaacaaaccgctgcgcaaagggaaacgggtgaccagattacgcacccgtaaaacaggttcgccatccaccaccgttttctgctcgatggggggttcctgtttcgctggatgttcaagcgatatcaatgggaaacgtcggggataatctaaccctttcatcgcaccaagttgcggaacagcagctaacagcgcacgggtgtacggatgttgcggtgcatgaaaaatatgttcgacgctacccgtttccaccgcctcgccctgatacatcaccagtacccgatcggcaatctctgccaccacgcccatatcgtgagtgataaagataacgcccatcgacatctctttttgcaatactttgattaattgcaggatctgcgcctgaatagtgacatccagcgcggtggttggctcatcggcaatcagcaccgccgggcggcatgacagcgccatcgcaatcatcactcgctggcgcatcccgccagagagttgatgcggataacgtgaaagaatggtttgtgcctccggaatgcgtacctgatccagcatccgcttcgcctcgaccattgcttcttcacgactggcgttttgatgcagacgaatagattcagcaatctgttcacccacagtaaataccgggttcagcgatgtcatcggctcctgaaatatcattgccatatccgcaccgcgcacatggcgcatttgtgcagcgctctgctcgctaagttcaatcacttcgcgactgcgccgccgcaacagcatttgatcgcactgcactaaaccgcccgcctgttccaacaagcgcattaatgccagcgcagtcactgacttaccagagccggattcgccaacaattgccagcgtctcaccgcattgcaggctaaaagagagattgcggaccgcagctattttctgctggtcctgcataaaggcaatattcagattttcaaccgccagcacatcaccggcatcaagttcatcactgtgtggcaacggtgtcccctttttcacggtagataccggtggttggcgtatcgcctgcgtagccccaggcgcgatacattccttcggtgttaaacggtagcgcgatattaccttcatggtcgatagcgattaagccaccgctaccgccaagcgcagggagtttttccattactacccgctcgcaggcttccgcgagacttaatccgccgtaatccattaacgcggcgatgtcatatgccgccagcgcgcggatgaagacttcgcccgtgccggtacatgaaaccgccacactggcgttattggcgtagcatccggcccccactaagggactatcgccaactcgtccgggtaatttattggtcattccgcctgtggacgtggctgccgccagattgccgtctaaatccaacgccacggcccccacagtgcccattttctgtttttcatccagtggcgcaccgctatggtcgaggaccatttccccttcctcgcgcgctgccagtagttgttcataacgcaaaggcgtggagaaaatctccggcgagacgcgctccatgccatgagcaaacgcaaaattttctgccccttcgccaatcatcatcacatgcgggctttgctccatcaccagccgggcggcaagaaccggattacgcagatgactaacgcccgccaccgcaccggctttcagggtgttaccatccatcacacaggcgtccagttcatgggtttcatcacgcgtaaagacagcgccaattccggcgttaaacagtggacactcttccagcagacgcaccgcttccgtcaccacatccagcgcactttcgcccgcttccagcattttctgcccggtttcaacaatggcagacagcgcctcgatgtagcgtaattcctgttgcagactcatctgcgcgcggctaattgcacctgcgccaccatgaattgcaatgactgctttgcccatagtattcgtccattaagggtggctcgccacttttgctataaatatcagaatttttatgaattactcattcaatttttgaatatagaaagatggatatggcatgtaaaggcaggagccagcgctacgcccgaggtggcatacagtctgtggcgtttttctgacataataggcaaattcgattttgcctccgcaggagtgttttcatggaatttaccaccggattgatgtcgctcgacatcgcgcttaatgagatgctttctcgcgttaccccactgaccgcccaggaaacgctgccactggtacagtgttttggtcgtattctggcgagcgatgtcgtttcgccactggatgtcccggggtttgataactccgctatggacggctacgcggcgcgtttagccgatattgcctccgggcaaccgctgcccgttgccggtaaatcctttgccggtcagccgtaccatggtgaatggcctgcgggtacctgcattcgtattatgaccggtgcgccggtgccggaaggctgcgaagcggtggtgatgcaggaacagaccgaacagactgacgctggcgtgcgttttactgctgaagtgcgtagcgggcaaaatattcgccgtcgcggtgaagatatctctgcaggtgcggttgttttcccggcgggaacacgcctgactaccgcagagctgccagtaattgcttcactggggattgccgaagttccggtgattcgtaaagtgcgtgtagcgctgttttctaccggtgatgaactccagttgccaggccagccgctgggcgacggccaaatctacgataccaaccgtctcgccgtacacctgatgttagaacagttgggatgcgaggtaatcaacttagggattatccgcgacgatccccatgccctgcgcgccgcatttattgaagccgacagccaggcggatgtggtgatcagttccggcggtgtttcagtgggtgaagcggattacaccaaaacgattcttgaagagctgggggagatcgccttctggaagctggcgattaaaccaggtaaaccgttcgcgttcggtaaactcagcaatagctggttctgcggcctgccgggcaacccggtttcagcaacgctgaccttctatcaactggtacagcctttgctggcaaaactaagcggcaataccgccagcggcctgcccgcgcgccagcgtgtacgcacggcatcgcgtctgaaaaaaacgccaggacgccttgatttccagcgcggcgtgctgcaacgcaacgccgatggcgaactggaagtgacgaccaccggacatcagggttcacatatatttagctcctttagcctcggcaactgctttatcgtgctggagcgcgaacgcggcaatgtggaagcgggcgaatgggtggaagtagaaccgtttaacgcgttgttcggaggcctgtaatggcggaactcagcgatcaggagatgctgcgctataaccggcaaatcattctgcgcggctttgattttgatggtcaggaggcgctaaaagattctcgtgtgctgatcgtcggcctcggtggactcggctgcgcagcctcacagtatctggcaagcgccggtgtcggcaacctgacgctgctcgacttcgacacggtttcgctctcaaatttacagcgccaaacgctgcacagcgatgccacagtcgggcaaccgaaggtggattctgcccgtgacgccctgacgcggatcaacccacatatcgcgattacgccagtcaatgcactgctggatgacgcagaacttgctgcgatgattgcaaaacacgatctggtgctcgactgtacggataacgttgcggtacgtaatcaactgaacgcaggctgttttgccgcgaaggtgccgctggtttccggcgcggcaattcgcatggaaggtcaaatcacggtcttcacttatcaggacggcgagccttgctaccgctgcctcagccgtttgtttggcgaaaatgcattaacctgcgtagaagcaggcgtgatggcaccgttgatcggcgtaattggttcgttgcaggcaatggaagcgatcaaactgctggcaggttatggcaaacctgccagtggcaaaatcgtcatgtacgatgcgatgacctgtcagtttcgcgaaatgaaactgatgcgtaatccgggatgtgaggtgtgcgggcagtaattgccacctccaggcctgataagacgcggcactgcgccacgtcatcagcaatttatgaggatgcagaacgtccggttaaatcgacgttctgccaaacgctccctgccagtcctgctcaaacttcgccacagcggcatcaaccgccggatagctaatcatctgttgtgccacatccagtggcagagtaattgattcacatcctgccagtaagcagtccagcgcctgacgcggggttttgaaacttgcggctaacacttttgcctgcggcgcatgcattttcaataactggtgtaagtcggtcacagtctgaatgccgctaccgccctgagcatcaatacgattaacgtaaggcgcaacatattccgcacctgccagcgccgacagtagcccttgtgctgcgccatataccgcggttcccagcgtcggaatcccttccgcttttaacatcttaattgctgccagcccctcagcggtcaccggaactttcaccacgatatccgcaataatagagcgcagcttacgcgcgtcattcaccatcccttcagcagtggtagccattacctgggcaaacagacgcccctgaccgcccatcgcttcatgaagttccggaagcacaacctccagcggttttttacccgctgcgataatgcttgggttagtggttacacccgccagcggaaaaatacgtgacagcgccttcaccgcaacaacgtctgaagtatccagatacagttccataaccatcctcaaaatgtactttttgtctgaatgtagactatcacgggaaaactctctgaacagttgacgcacatcaatctaactttcattcgaaagtattttaatgtttgaacgaaacagagaggcaactatgattttcaatattcagcgctactcgacccatgatggccccggtatccgcacggtcgtatttcttaaaggctgttcgctgggctgccgctggtgtcagaacccggaaagccgcgcccgcacgcaagatctgctgtatgacccacgactctgtctggaaggctgtgagctgtgcgctaaggccgcgccggaagtgattgagcgcgcgttgaatggtttgcttattcatcgagaaaagttaaccccggagcattttacggcgctaaccgactgctgcccgacacaggcattaaccgtgtgtggtgaagtgaaaagcgttgaggagatcatggcgaccgttttgcgggataaaccgttttacgatcgcagcggcggcggcttaacgctttcgggcggtgaaccgtttatgcagccggaaatggcgacggcgctactgcaagccagccacgaggccggcattcatactgcggtagaaacctgtctgcatgtgccgtggaaatatatcgccccttctctgccctatatcgatctgtttcttgccgatttaaaacacgttgccgacgcgccgtttaaacagtggaccgacggtaacgccgccagagtgctggataacctgaaaaaactcgccgcagcgggcaaaaaaatcattatccgcgtgccgctgattcagggctttaatgccgacgaaacctctgtaaaagccattaccgattttgccgccgacgagctgcacgttagcgaaattcatttcctgccctaccacacgctgggcatcaacaaatatcacttacttaatctgccctatgacgccccggaaaaaccgcttgatgcgccagaactgctcgactttgcccagcagtatgcctgccagaaagggttaaccgcgaccttacgaggataacaaccatgaccacactgaaactggacacgctcagcgatcgcattaaagcgcacaaaaatgcgctggtgcatattgtgaaaccgccggtctgtaccgagcgcgcgcagcactataccgagatgtatcaacaacatctcgataagccgatcccggtacgtcgcgcgctggcactggcgcatcacctggcgaatcgcaccatctggatcaagcacgatgagttgatcattggcaaccaggcaagcgaagttcgcgccgcgccgatcttcccggaatatactgtctcatggatcgaaaaagagatcgatgatctggcagatcgtcccggtgctggctttgcggtgagcgaagagaacaaacgcgttctgcatgaagtgtgcccgtggtggcgcggtcagaccgtacaggatcgctgctacggcatgtttaccgatgagcaaaaaggtctgctggcgaccggcatcattaaagcggaaggcaatatgacctccggcgatgcgcacctggcggtcaatttcccgctgctgctggaaaaagggcttgatggtctgcgcgagaaagtagcggaacgtcgctcgcgcatcaacctgacggtgctggaagatttacatggcgagcaattcctgaaagcgattgatatcgtgctggtagcggtcagtgaacacattgaacgtttcgctgccctggcgcgtgaaatggccgcgaccgaaactcgcgaaagccgtcgcgatgaactgctggcgatggcagaaaactgcgatcttatcgcccaccaaccgccgcagactttctggcaggcgctgcaactgtgttacttcatccagttgattttgcagatcgaatctaacggtcactcagtatcttttggtcgtatggaccagtatctgtacccgtattatcgtcgcgacgttgaactcaaccagacgctggatcgtgaacacgccatcgagatgctgcatagctgctggctgaaattgctggaagtgaacaagatccgctccggctcgcactcaaaagcctctgcgggaagtccgctgtatcagaacgtcactattggcgggcaaaatctggttgatggtcaaccaatggacgcggtgaatccactctcttacgcgatccttgaatcctgcggtcgcctgcgttccactcagcctaacctcagcgtgcgttaccacgcgggaatgagcaacgatttcctcgacgcctgcgtacaggtgatccgttgcggcttcgggatgccggcgttcaacaacgacgaaatcgtgatcccggaatttattaaactcggtattgaaccgcaggacgcttacgactatgcagcgattggttgtatcgaaaccgccgtcggtggcaaatggggctatcgctgtaccggcatgagctttatcaacttcgcccgcgtgatgctggcggcgctggaaggcggtcgtgatgccaccagcggcaaagtgttcctgccacaagaaaaagcgttgtcggcgggtaacttcaacaacttcgatgaagtaatggacgcatgggatacgcaaatccgttactacacgcgtaaatcaatcgaaatcgaatatgtcgttgacaccatgctggaggagaacgtgcacgatattctctgctcggcgctggtggatgactgtattgagcgagcaaaaagtatcaagcaaggcggcgcgaaatatgactgggtttctggcctgcaggtcggcattgccaacctcggcaacagcctggcggcagtgaagaaactggtgtttgaacagggcgcgattggtcagcaacaactggctgccgcactggcggatgacttcgacggcctgactcacgagcaactgcgtcagcggctgattaacggcgcgccgaagtacggcaacgacgacgatactgtcgatacgctgctggctcgcgcttatcagacctatatcgacgaactgaaacagtaccataacccgcgctacggtcgtggtccggttggcggcaattattacgcgggtacgtcgtctatctccgctaacgtaccgtttggcgcgcaaactatggcaacgccggacggacgtaaagcgcataccccgctggcagaaggcgcaagcccggcctccggtactgaccatcttggccctaccgcggtcattggctcggtgggtaaactgcctacggccgcgattctcggcggcgtgctgctcaaccagaaactgaatccagcaacgctggagaacgaatctgacaagcagaaactgatgatcctgctgcgcaccttcttcgaggtgcataaaggctggcatattcagtacaacatcgtttcccgcgaaacgctgctggaagcgaaaaaacatccggatcagtaccgcgatctggtagtgcgtgtcgcgggctattccgccttcttcaccgcgctctctccagacgctcaggacgatatcatcgcccgtactgaacatatgctgtaatctcctcagcccggcggcggcgtcgccgggctaaatcattcacatcatcaatttcagcctcgctttcattcgaaatataatttgtgctctgcgtcacattgttattacactgttacggtttcattttcgagccaggagcacacctatgagcgtaaaagttatcgtcacagacatggacggtacttttcttaacgacgccaaaacgtacaaccaaccacgttttatggcgcaatatcaggaactgaaaaagcgcggcattgagttcgttgtcgctagcggtaatcagtattaccagcttatttcgttctttcctgagctaaaggatgagatctcttttgtcgcggaaaacggcgcactggtttacgaacatggcaagcaactgttccacggcgaactgacccgacatgaatcgcggattgttattggcgagttgctaaaagataagcaactcaattttgtcgcctgcggtctgcaaagtgcatatgtcagcgaaaacgcccccgaagcattcgtcgcactgatggcaaaacactaccatcgcctgaaacctgtaaaagattatcaggagattgacgacgtactgttcaagttttcgctcaacctgccggatgaacaaatcccgttagtgatcgacaaactgcacatagcgctggatggcattatgaaacccgttaccagtggttttggctttatcgacctgattattcccggtctacataaagcaaacggtatttcgcggttactgaaacgctgggatctgtcgccgcaaaatgtggtagcgattggcgacagcggtaacgatgcggagatgctgaaaatggcgcgttattcctttgcaatggggaatgctgcggaaaacattaaacaaatcgcccgttacgctaccgatgataataatcatgaaggcgcgctgaacgtgattcaggcggtgctggataacacatccccttttaacagctgacctctctaccggagccatgcgctccggttttcccttctttttacatcctgtacatcacatcaaatcattaaacttgcattaacttatttataacttatattgtcacatgcaaatcataatagtttcgaatgaaagttaatgcgaggtggttatggcttctacttttaccagcgacacattgcctgccgatcacaaagcagctatccgtcagatgaagcacgcgctgcgggcacagcttggcgacgtccagcagatctttaatcagctaagcgatgacattgctacgcgagtggctgaaatcaacgcactcaaagcacagggcgatgccgtctggccggtgctgtcttatgccgatatcaaagcaggtcatgttactgcagagcagcgcgaacagattaaacgtcgcggttgtgcggtgataaaaggccatttcccccgcgaacaagcgctaggctgggatcagtcgatgctggactatctggaccgcaaccgctttgacgaggtctacaaaggccccggcgataatttcttcgggacgctcagcgcttcacgtcccgagatttaccccatctactggtcgcaggcgcaaatgcaggcccgccagagtgaagaaatggcgaatgtgcagtcgtttctcaatcgtctgtggacatttgaaagtgatggaaagcaatggtttaacccggatgtgagcgtcatctaccctgaccgtatccgccgccgtccgcccggaacgacctccaaaggtcttggagcgcataccgactccggggcgctggaacgctggctgcttccagcgtatcagcacgttttcgccaacgtctttaatggcaatctggcgaaatacgatccctggcatgcggcacatcgtacggaagttgaagagtacacggtggacaacaccaccaaatgttccgtgtttcggacattccagggctggacagcgctctctgatatgctgcctggtcaggggttgctgcacgtcgtgcccattcctgaagccatggcgtacgtactgttacgtccgctgcttgatgatgtgccggaggatgaactgtgcggcgtagcgcccggaagagtgttgccggtatcagagcaatggcatccactgttaattgaggcgttaaccagcattccaaaactcgaggccggagactccgtctggtggcactgcgacgtcatccattccgttgcccccgttgaaaatcaacagggttggggcaacgtgatgtacattcctgcggcaccgatgtgcgagaaaaatcttgcctacgcgcacaaggtgaaggccgcactggaaaaaggcgcatcgccgggcgacttcccgcgcgaggactatgaaacaaactgggaaggacgctttacgcttgccgacctcaacattcacggtaagcgagcgttgggaatcgacagctgagtgtcgtacagcccttcccgttccacggcggtgttcccttttcctgggcgaacccgccgcactgactcccgcaccgccaatcgtccgtgcagcagcagcgagcccaccggagcatccgggcgaatcagccgctgttgcaacatttgcaccgcttcattgcctagctcatcgcgtggcacatgcacagccgtcaggggaacatcctcgattgccgcaaggttaaagccgtcgatactcatcaccgagacatcctgtggtacgcgcagaccacgacgatgtagcgcatttaccgttcccgccgccataaaatccccgccgaccagaaacgccgtcggcaacgtcttgccattggcggcatccagccacgctccgaccttttcttccgcttctttagcgctaaaactgctgatattcagcaaatgacggtcatggtgaaaggccagattatgctgacgccatgattctttaatccctgcaaaccgctgctccatagtgtagcggcgcaggcacatcacattcatcacctcccggtgacccatttcaaacagatagcgggcggcgaacgcgccaattaaccgatggtccggcgcaatcgccgggaggcgcattcgttcatcacggcagttgatcagcacacaaggcttagcgagatcggcggccagatcatggatgtgcggatcgtcaatccccagcaggatcgccgcctgcgtatctgcttcattcatccgcgagagaaatagcgcgggatcgctgtcaaactcctccagcgcgcagtaacgcagccgcacttcatgcggcgataacgctttgctgatgctctggatcacacggtaataaaagatatcagatcgttggtcaaaagcgcgttgctgcgcgaaaataatcaggttgttcagcaacatacgacctgctgccatgccatccatcacgcccaactcacgcgcgcaggccagcacctgttcgcgagcgcgtgcactggtattcgctttgccagccagcacccgcgaaaccgtactcggcgatagcccggtacgtgcggcgatatcggcgattttcagcttcttgtccattttgtgatctgcctctaattcggaaatgacagaattttcatgagcaaaaaagcccattctgtctggcattaaatccatttcagtaatgtatatcagtcactcatggaaaaacgtgcacaaaacccgctttctttcgcttttagggtctcttactgtgaattggtagaacaacttccatacaaaaataatggaaaaacgaacaataaagactttatttatcaaaaagttaaaagtggtgtgacaactccattctgacgttgccacacaaaccctataccattctgtggagtgcatatgagtcagggtatcaataacgatatgactgccagtaaaccgcgccatatcgtcaaaaatctgcgttggtggatactggtcctttttttgctcggtgttactgtcaactacatcacgcgtaactcgctgggtattctcgcccccgaactgaaaagcaacctggggattaccaccgaacaatattcctggattgtaggtgctttccagctcgcctataccctattccaaccgttgtgtggatggctgattgacgtcattggcctcaaactgggctttatgatctgcgcgggactgtgggcgctggcctgtctgatgcatgcgggggcgggaaactgggtacatctggcgctgttgcgcttctttatgggcggtgcggaagccgcggcaaccccagcaaacgccaaaaccatcggtgaatggtttccaaaatcagaacgcccgatcgccgcaggctgggcaggcgtcggtttttccatcggtgccatgctggccccaccgattatctattttgcccacgcttcattcggctggcagggtgcatttatgttcactggcatcctggcgatgctgtgggtggtgctgtggtgggcgttctatcacaacccggataagcatcctaacctcagcaaagccgagctggactttatccgccaggataacgaagcgccccctgtcaagttaccctttctgaccgcactgaaaaccgtaggcaaaaataaacgcttttacggtatcgctatcccggcctttatggcagaaccggcgtgggcggtgatgagtttctgggttccgctatacctgtccaaaacctatggcatggaccttaagcagatcgcattattcgcctggttgccgttcctcgccgctgatcttggcagtattgccagcggctatctgaccaaactttacacccgcctgtttgggctgagtcgtgtgaactccgttgtcgcatcatcggtcagtggcgcattcctgatggtttcgctggcggtgatggcctttaccaataacccgtatatcgccatcgtccttatttccatcggcggcttcggtcaccagatcatctcctgcatgctgagcgcactggtggtggaatccttcgacaaaggtcagatggccactgttaacggcatgcgcggttctgccgcgtggatcgcaagtttcctgttctccctgattatcggggttaccgctgacaaaatcggctttaaccccctgtttatcgccatgggcttctttgacctgattggtgctttcttcctggtcacctttattgctgaacgtcgcgcaaaacgcgcctgagaatggatgtaaacatgaaaacgctgaaaaactggaccctgcacaaacagtctgcccaccacgttgaactgctggtcgatggccagcatatcctgtgcctgtacgtgctggaagaaaatctgttccgcgtgctgttaaaacgcaaaggcgagctggcgctggatcgcacctggagcattgctccggcgcaggatgtgccatgggaagggcgcagccgcgaagatctcagcggctttagcctgcccgcgtggacattgatccagcacgacgacaccgtggttatcgccaccgagtcactgcgtgccaccgttcaccagccgctgtggctggagtggcactatcgtaacaacgaaggcgaatggctgccgttggtgaatgaccgcccgaccagcgcttatctgctgaatgcccacggcgacggcgtggcgcactatcagagccgtcgtaaagatgaacgcttttatggcctcggagataaagccggcgacctgcaacgcaacggtaaacgttacgagatgcgtaacctcgacgcgatgggctacaacgccgtgagtactgacccgttgtacaaacacattccattcaccatcacccgccgcgatgacattagcttcggcctgttttatgacaacctcagcagctgctggctggatctgggcaacgagatcgacaactaccacaccgcctatcgccgctggcaggcggaagcgggtgatatcgactactacctgtttaccggcgaacgcgtacttgatatcaccaaagccttcgtacgcctgaccggcaaaaccctgttcggaccgaaatggagcctgggctacagcggttcaactatgcactacaccgatgcgccggacgcacaaaatcagttgatgaactttatccgcctgtgtgaagaacatgcaattccctgcgattcgttccagctctcatccggttatacctcaattaacggcaaacgctatgtgttcaactggaactacgaaaaagtgccgcagccgaaagtgatgagccaggcatttcacaatgctggtttgcacctggccgccaatatcaagccgtgcctgttgcaggatcacccacgctataacgaagtggcagaaagaggactattcatccgtgattcagaaacagatgaaccagaacgttccagcttctgggatgacgaaggttctaacctcgactttactaatccgcagaccatccagtggtggcaggaaggcgtgaccacacagcttctggagatgggtatcgactccacctggaacgacaacaacgaattcgaagtatgggacggtgaagcacgctgtcacggctttggtcagacgatcgcgatcaaacatattcgcccagtgatgccactgctgatgatgcgagcctcgatggaagcccagcagcgtttcgctccggaaaaacgtccgtacttgatctcccgctccggctgcgcgggaatgcagcgctacgtgcagacctggagtggcgataaccgcactagctgggacactctgcgctacaacacccgcatgggtctggggatgagcctctccgggctgtataacctcggtcacgacgtcggcggtttctccggtgataagccggacccggaactgtttgtacgctgggtacaaaacggcgtgatgcatccgcgctttacgattcactcatggaacgatgaccataccgtaaacgaaccgtggatgtatccgggcgtcactccggcgatccgcagcgctattgagttgcgctatcgcctgctgccctacttttataccctgatgtggcaggcatacgccgatgatgaaccaatgctacgtccgactttccttgaccacgagcacgacgttcagacttttgaagagtgtgatgacttcctgcttggtcgcgatattttggttgccagcgtcgtagagcaaggcgagcgccagcgccgtgtatggctgccagataacgaaactggctggtacgatttctacaacggcgaatggttcagtggcggtcagtggatcaccctcgacgcaccgctggagaaactgccgctgatggtgcgtgccggggctggtctaccgctcagcaaacgcatcacctatgtgagcgcagaacaagacgatacccgcgaactgaaactgttcccgctgaaaggtgtgggcacaacgtccggcctgctgtttgaagacgatggcgaaagctggggctaccaaactggtaatgcgctttgggtggaatgggaaatggtttgcgatggggcgaccatcaacctgaaagtcaacgcgcgcggggattatcgacctgcatggagtgcactgaaagtgtcattaccagtggaagaaaaacgcacgctgctggtcaatggtgttgaagggagtgaatggatgcgttaaatcattaccggggccgggaggcgactgcgccttacccggtccagccatcgaatcctttacctcagtatttcacgctgcaggaaggcagcaaacctgtaaaccccgggagcttaaataagtaagtgaccggggtgaacaggtgaagccaatgcatctgccgcatgaaagacggcgggaaattaaccgtcgatccctttactacgcagataatcttcgtaattaccgctaaagtcgatcacgcgttccggggtgatttccagaatacgggtcgccagggagcttacgaactcacggtcgtgtgaaacaaagatcagcgtgccctgatacagttccagcgccatgttcagcgactcaatagattccatatccaggtggttggtcggttcgtccatgatcagaatgttcggcttctgcatcattaatttaccaaacagcatccgccctttttctccaccggaaagcactttcgctggctttttgatgtcgtcctggctaaacagcaaacgaccgagaatgctgcgtaccgcctgctcgtcatcgccttcctgcttccactggctcatccattcgaacacggtcagatcattttcgaactcatattcatggtcctgggcgtagtaaccaatgcgtgcgttttcagaccattttacggtgccgctgtccggttgcagatcgcccaccagcgttttcagcagcgttgatttaccgacgccgttggtacccagtaccgccagtttttcaccgacctccagcagcaggttgagatttttaaacagcggaccgttatcaaaccctttggtcagaccttccacttccagcgcgttacggaacagtttcttatcctgttcaaaacggatgaacgggttctgacggctggaggctttcacctcttccagtttgattttatcaatctggcgcgcgcgcgaagttgcctggcgagatttcgaggcgttggcactaaagcggctaacgaaagattgcagctcagcaatctgcgctttcttcttggcgttatcagccagcagacgctcacgcgcctgggtcgccgccgtcatgtactcatcgtagttacctggataaacgcgcagctcgccgtaatccagatcagccatgtgggtacaaaccatgttaaggaagtgacggtcgtgcgagatgatgatcatggtgctgtcacgctcgttcagcacctgttccagccaacgaatggtgtcgatgtcgaggttgttggtcggttcgtcgagcaggagaatgtccggatcagcaaacagcgcctgcgccagcagcacacgcagcttccagccaggagcaacttcactcatcgggccgtagtgctgttccactggaattcccacgccaagcaacagttcaccggcgcgagcttccgcagagtaaccgtccatttcgccgtatttcacttccagatcggccactttatagccgtcttcttcactcatttccggcaaagcatagatgcggtcacgctcctgcttcacttcccacaactctttatgccccatgatcaccgtatccagcacagtgaactcttcaaaggcaaactgatcctgacgcagcttaccaatgcgctcgttgggatcgagggaaacgttacccaacgtcggctctaagtcgccgccgaggatcttcataaaggtggatttaccactaccgttcgcgccaatcaggccgtaacggttgccgccgccaaatttgacggaaatgttttcaaacaacggcttactgccgaactgcatggtgacgttactggaaactaacacaggcgtatcctgaaaagagatatgacaaaccgcgcattatgccataagtctgaaagaagatcctgctcctcgcttaaggtctacactcaagccaaaggcaaaaaatgtgatttcgtacacatctgatttcactgtgagcaggaatgaacttataatgcgcttccaatactctaatattctcaacccaatggcctgccaggcacaaaatctcgcttaacatgaatatgaaattgaaaacattattcgcagcggccttcgctgttgtcggcttttgcagtaccgcctctgcggtaacttatcctctgccaaccgacgggagtcgcctggttggtcagaatcaggtgatcaccattcctgaaggtaacactcagcctctggagtattttgccgccgagtaccagatgggtctttccaatatgatggaagcgaaccccggtgtggataccttcctgccgaaaggcggtactgtactgaacattccgcagcagctgatcctgccggataccgttcatgaaggcatcgtcattaacagtgcagagatgcgtctgtattactatccgaaagggaccaacaccgttatcgtgctgccgatcggcattggtcagttaggcaaagacacgcctatcaactggaccaccaaagttgagcgtaagaaagcaggcccgacctggacgccaaccgctaaaatgcacgcagagtaccgcgctgcgggcgaaccgcttccggctgtcgttccggcaggtccggataacccgatgggtctgtatgcactctacatcggtcgcctgtacgcaatccatggcaccaacgccaacttcggtatcggcctgcgcgtaagtcatggttgtgtgcgtctgcgtaacgaagacatcaaattcctgttcgagaaagtgccggtcggtactcgcgtacagtttattgatgagccggtaaaagcgaccaccgagccagacggcagccgttatattgaagtccataacccgctgtctaccaccgaagcccagtttgaaggtcaggaaattgtgccaattaccctgacgaagagcgtgcagacagtgaccggtcagccagatgttgaccaggttgttctggatgaagcgatcaaaaatcgttccgggatgccggttcgtctgaattaatcgtcaaaacgtaaaacagaggcggactcatcatccgccttttttatttgccagaccctaccaggccgggagcataacgaataaaacgtatcccaccagcgccgcccacaacagcatcggtattgaatagagatggaaacgccaccagatacggcgatcgttcgccatccgtaacgcaatcaaatttgccagcgatccgggtaataaaccaaagccccccacgtttaccgcccatgccagcagcaacgacggcggcacatagttcagcaacaatatggtactcggcacgttactgatcacctgcgataaaccgattgccgttaaccataatccgggttcggataaatgactcacgttacttaacaccccctgcaaagctggcagttgggttagtaaatggacgtcgataaacatcgccataaacaccagcagcagcgtccagtccacactcaacaccacgcgacgtgccagcagcgcaaagcccgccgccacaatcaccagtccccacagctcttgttttaactccagcgccgtcagaaagacgatatacagccccagacaactccacaccagccgcggtttccactccggagtttgcacccccgtatggtattgcagtgcctttccagggaaacaacaccagcacaggagcaggagcgtcagcatcattgcgccagccagtggtgccatttgggcaataaatccggcaaacgaaagaccagaacgtccccagataagaatattttgcgggttgccaattggcgtcagtagcgaaccagcgttgactgccagcgcttcaaaaataatcagccgattaaccgggatctcacacagtctttttagcgtgatagtcagcggaacaacaataaacagcgcgacatcgttggtcagaaaggtagaaagcagcgccgccgccagcaccataaacatcgccagccgacgctccgtagcaaagcggcgcaccattttgcgccccagcacatcaaaataaccgcttagctccacacctttagtcagcagcatcaggccgcttaaggtgatgatggtgtgccagtcgatagcagcaggccaggatttcggtgcaaagggaacaaaaaaacttaatccgacgccaacaagaattaataactgaaaaaaacgatcgccttgcagcgtgcgtaaaaaaggcaggctcatttggcaccgtgtttctgggtaaacaaacgaaaagcgtcgagcgtctcttcactaacatggtgctccatgccttccgcgtcgcgacgggcaatttccggactgacgcccaacaccaacaagaaattttcgactatctgatgtcgctcgcggctttcctgcgccagcttctctccttctgccgttaaaaacacgccacgccaggggatcatttcaatcagccccatggttgccagtcgcttaagcattttagccaccgtcggttgcgaaactcccaaacgagcagccatgtctacctgacgagcttcccccacttccctgatcaagtcagaaatcagctcaacgtaatcatcaataagctcgcgccgatgcgcctctctgacctggcggaacccttcaacgtgctcttccacgttcactaactgcgtcactttttttgctgttggcgtacctgcgcgacgactcattgtgcttcctcattatggtgacgcatacctagcgttctcatttcgtgcgcacattgtaaaccagagttgcgaaggtacaaaaaattaacgttttagcaatagctatataatatagcctgtgctatatctgtatgtaatgcaatcatccctcaaggatcgacgggattagcaagtcaggaggtcttatgaatgagttcaagaggtgtatgcgcgtgtttagtcattctccctttaaagtacggttaatgctgctctctatgttgtgcgatatggtcaacaacaaaccgcagcaagataaaccttccgataaatagcggcgtcgcggtacgccgcttcactcctgcttttatgcaggcacaacgcgttttgccctgaaaaaccccactttttgtcggatttgcaatccccttcgcaaaagatttgttcgtcagtagttgacctgaacggcagctcgctctatcttcttgcagccctgcgtatattgcggctcgcggatgcggacccctttcccctcttcacgcactcttgcaggtattgacccttgacgccagggtaagcacatggcgtttgttacgatagtggcatatgaatttaaccctcaaagaatcgcttgttacccgtagccgggtatttagcccgtggactgcgttctactttttacagtcgctattaattaacctcggcttaggttaccccttcagtttgctctacaccgccgcatttacggctattttgcttttgctatggcgaacattgcctggcgtacaaaaagttctggtcggtgtcagttcgctggtggcggcttgttatttcccttttgctcaggcctacggcgcgcctaatttcaatacattgctggcattgcactccaccaatatggaagagtcgaccgaaatcctgacgatttttccgtggtacagctacctggtcggcttatttatttttgcgctcggcgtaatagcaatcaggcgaaaaaaagagagtgaaaaagcgcgctggaataccttcgacagcttgtgtctggtattcagtgtggcgacattttttgttgctcccatgcaaaacctggcctggggcggcgtatttaaactgaaagatactggctatccggtatttcgttttgctaaggatgtcatcgtcaataataacgaggtgattgaagagcaagaacggatggcaaaactttccggaatgaaagatacctggacggtcactgccgttaagccgaaatatcagacctatgtggtggtgatcggtgaaagcgcgcgtcgcgatgccctcggtgcctttggcggtcactggaacaataccccgtttgccagcagtgttaacggtttgatatttgctgactacattgccgccagtggctccacgcagaaatcgcttggcttaacgctcaatcgcgtagtcgatggcaaaccacagtttcaggataactttgtcaccctggcaaatcgcgcgggcttccagacctggtggttttccaaccagggccaaatcggcgaatacgataccgccatcgccagcatcgccaaacgtgcagatgaagtgtacttcctgaaagaaggtaattttgaagcagataaaaacacgaaagacgaagcgttactggatatgaccgctcaagtgctggcgcaagagcactcgcaaccgcagctgattgttttacatctgatgggctcacatccgcaggcctgcgaccggacacaaggcaaatacgaaacctttgtgcaatcgaaagaaacgtcgtgctatctctataccatgacgcaaacagacgatttactgcgcaagctgtacgatcagttacgcaacagcggcagcagcttctcgctggtttacttttctgaccacggtctggcttttaaagagcgcggcaaagacgtgcaataccttgcccatgatgataagtatcagcaaaatttccaggtgccttttatggtcatttccagcgacgataaagcgcatcgggtgattaaagcccgccgctcagccaatgacttcttaggctttttctcgcagtggacgggaattaaagcgaaggaaattaacatcaaatacccgtttatatctgagaagaaagccgggccgatatacatcaccaacttccagttacagaaggtggattacaaccatctcggaaccgatattttcgacccgaaaccttaaaaacaaaaatccgccccgagaggcggattttttatatcaccgaagtgattagaagcggtaaccaacaccggcaatccaggtgcctacgtcaacgctacgaatacggctctgctcgtaagagaagtccagagcaacgttttccatcgggttgaactgcagaccagcaccgtaggagaaaccgtagtcgctggtgtcgtgtttgtaagtcgggtattcagtggtctggaatttaccataacccacacccactacaccgtagatgcttgcccagtcgttaatgcggtaagccggaccagcagtgatgccgtagtactggtttttgttgtagtcaccagagcttgcagtacggcttttctcggtgtaagtgaaagaaccgatcacacccagcgggctgttgtcttcttcatagcggtatttcaggttgaaaccgcccattttgttcatttggccctgagcgtcgctctgtgcgtaaccgccagttacggtagaagttgcagctacggaagtacctgcggtgaaagccagaactgcggccagtgctgaaagacatgcaatttttttcataaccacctcaaatgtgattcaaataagtcctaagttttaaatatatcaaaaattaatgggaaactcttcgcgatttgtgatgtctaacgggccatttcatgtaacagaacgtttccatacaccgctatccatctaaatttaaatcactttttcagagaactgcgtaagtattacgcatgttttccctgtcattcatccagattattcctaatcaccagactaatgattccatcaatcctggcgcattttagtcaaaacgggggaaaattttttcaacaaatgctcaaccagcattgggtatatccagtacactccacgctttacttaagtctagatatttgtgggagaaaggatgcctggttcattacgtaaaatgccggtctggttaccaatagtcatattgctcgttgccatggcgtctattcagggtggagcctcgttagctaagtcactttttcctctggtgggcgcaccgggtgtcactgcgctgcgtctggcattaggaacgctgctcctcatcgcgttctttaagccatggcgactgcgctttgccaaagagcagcggttaccgctgttgttttacggcgtttcgctgggggggatgaattatcttttttatctttctattcagacggtaccgctgggtattgcggtggcgctggagttcaccggaccactggcggtggcgctgttctcttctcgtcgcccggtagatttcgtctgggttgttctggcggttcttggtctgtggttcctgctaccgctggggcaagacgtttcccatgtcgatttaaccggctgtgcgctggctctgggggccggggcttgttgggctatttacattttaagtgggcaacgcgcaggagcggaacatggccctgcgacggtggcaattggttcgttgattgcagcgttaattttcgtgccaattggagcgcttcaggctggtgaagcactctggcactggtcggttattccattgggtctggctgtcgctattctctcgaccgctctgccttattcgctggaaatgattgccctcacccgtttgccaacacggacatttggtacgctgatgagcatggaaccggcgctggctgccgtttccgggatgattttcctcggagaaacactgacacccatacagctgctggcgctcggcgctatcatcgccgcttcaatggggtctacgctgacagtacgcaaagagagcaaaataaaagaattagacattaattaaatttacatttctgcatggttatgcataaccatgcagaatttctcgctacttttcctctacaccgtctttatatatcgaattatgcaaaagcatatttattccgaaaattcctggcgagccaataaataagaattgttcttatcaatataactaacccattgaatttttattagttttgtttttcacgcttgttaccactattagtgtgataggaacagccagaatagcggaacacatagccggtgctatacttagtctcgttaattactgggacataacatcaagaggatatgaaattatgagtaccgctaaattagttaaatcaaaagcgaccaatctgctttatacccgcaacgatgtctccgacagcgagaaaaaagcaacagtagagttgctgaatcgccaggttatccagtttattgatctttctttgattaccaaacaagcgcactggaacatgcgcggcgctaacttcattgccgtacatgaaatgctggatggcttccgcaccgcactgatcgatcatctggataccatggcagaacgtgcagtgcagctgggcggtgtagctctggggaccactcaagttatcaacagcaaaactccgctgaaaagttacccgctggacatccacaacgttcaggatcacctgaaagagctggctgaccgttacgcaatcgtcgctaatgacgtacgcaaagcgattggcgaagcgaaagatgacgacaccgcagatatcctgaccgccgcgtctcgcgacctggataaattcctgtggtttatcgagtctaacatcgaataaatccatcgctgatggtgcagaactttagtacccgataaaagcggcttcctgacaggaggccgttttgttttgcagcccgcctcaacgcacttatttagtgcatccatctgctatctccagctgattaagtaaattttttgtatccacatcatcacacaatcgttacataaagattgttttttcatcaggttttacgctaaataatcactgtgttgagtgcacaattttagcgcaccagtttggcgccccagaatggtgcatcttcagggtattgccctataaatcgtgcatcacgtttttaccgcatctcgataaatcaatgagttgcaaaactggcacgattttttcatatatgtgaatgtcacgcaggggatcgtcccgtggatagaaaaaaggaaatgctatgaagtctgtattaaaagtttcactggctgcactgaccctggcttttgcggtttcttctcatgccgcggataaaaaattagttgtcgcgacggataccgccttcgttccgtttgaatttaaacagggcgataaatatgtgggctttgacgttgatctgtgggctgccatcgctaaagagctgaagctggattacgaactgaagccgatggatttcagtgggatcattccggcactgcaaaccaaaaacgtcgatctggcgctggcgggcatcaccattaccgacgagcgtaaaaaagcgatcgatttctctgacggctactacaaaagcggcctgttagtgatggtgaaagctaacaataacgatgtgaaaagcgtgaaagatctcgacgggaaagtggttgcggtgaagagcggcactggctccgttgattacgcgaaagcaaacatcaaaactaaagatctgcgtcagttcccgaacattgataacgcctatatggaactgggcaccaaccgcgcagatgccgttctgcacgatacgccaaacattctgtacttcatcaaaaccgccggtaacggtcagttcaaagcggtaggtgactctctggaagcacagcaatacggtattgcgttcccgaaaggtagcgacgagctgcgtgacaaagtcaacggcgcgttgaaaaccctgcgcgagaacggaacttacaacgaaatctacaaaaaatggttcggtactgaaccgaaataataacgctacgcctgtaaggcgcactggcagttccctctcccctctggggagaggattagggtgaggggcgcaaacccgctccggggccattaattaccctgaatttgattatttacaccacggtaacaggaacaacatatgcagtttgactggagtgccatctggcctgccattccgcttctgattgaaggtgccaaaatgaccctgtggatctcggtcctcggtctggctggcggcctggtgatcggattgctggcaggttttgcacgcaccttcggtggttggatagccaaccacgtcgcgctggtctttattgaagtgatccgcggcacacctatcgtcgtccaggtgatgtttatctatttcgccctgccgatggcgtttaacgacttacgcatcgacccgtttactgcggcggtggtcaccatcatgatcaactccggcgcgtacattgcggaaatcacgcgtggtgcggtgctgtctattcacaaaggttttcgtgaagcaggactggcgctcggtctttcacgttgggaaaccattcgctacgtcattttaccgctggcactgcgtcgtatgctgccgccgctgggtaaccagtggatcatcagcattaaagacacctcgctgtttattgtgatcggcgtggcggaactgacccgtcaggggcaagaaattattgccggtaacttccgcgcccttgagatctggagcgccgtggcggtgttctatctgattattaccctggtgctgagctttattctgcgtcgtctggaaagaaggatgaaaatcctgtgattgaatttaaaaacgtctccaagcattttggtccaacccaggtgctgcacaatatcgatttgaacattgctcagggcgaagtcgtggtgattatcgggccgtccggttccggtaaatcgaccctgctgcgctgcatcaacaaactggaagaaatcacctccggcgatctgattgtcgatggcctgaaggttaacgatccgaaagttgacgagcgcctgattcgccaggaagcgggtatggtgttccagcagttttacctcttcccgcatctgacggcgctggaaaacgtgatgtttggtccgctacgcgtgcgtggcgcgaacaaagaagaggcggaaaaactggcgcgtgagctgctggcgaaagtcggtctggcagaacgtgcacatcactacccttccgaactttctggtggtcaacagcagcgtgtggccatcgcccgcgcgctggcggtgaagccgaaaatgatgctgtttgatgaaccgacttccgctcttgacccggaactgcgccatgaagtgctgaaggttatgcaggatctggctgaagaagggatgacgatggtgatcgtgacccacgaaatcggttttgccgagaaagtagcttcgcgccttatctttatcgacaaaggccggattgcggaagatggcgatccgcaggtgttgatcaagaacccgccgagccagcgcttgcaggaatttttgcagcacgtctcttaataagacacattgcctgatgcgctacgcttatcaggcctacaggatatctggcaacttattaaaattgcatgaacttgtaggacggataaggcgttcacgccgcatccggcaaaaaagcccgcacgttgtcagcaacctgcttaatatcccttcctccctttcccccgaaagggaggcacaccagattcctctcatttaaaatcgcccctcccccagcatctatacttatctttttgctctgttttctcactggaggagtcatgcggtggatcctgttcatcctcttctgcctgctgggcgcacctgcccacgcggtatccatacccggcgttacaaccacaacgacaacggactcaacgactgaaccggccccggaaccggatatcgaacaaaaaaaagcggcctatggcgcactggcggatgtgctggataatgacacctcgcgtaaagaattgatcgaccagttgcgcaccgtcgccgctacgccccctgcggaaccggtaccaaagatcgtgccgccgacgctggttgaagagcaaaccgtgctgcaaaaggtcaccgaagtcagccgccattatggtgaagccctttccgcccgcttcgggcaactttatcgcaatatcaccggctccccgcataagccgtttaatccacaaaccttcagcaatgcgctgacccatttttcaatgttagcggtattagtgtttggtttttactggctgattcgcctgtgcgcacttccgctgtatcgcaaaatgggccagtgggcgcggcaaaaaaatcgtgagcgcagtaactggttgcagcttccggcgatgattatcggggcgtttattatcgacctgctgttactggcactgacattatttgtcggtcaggttttaagcgacaacctgaatgcgggcagtcgcaccatcgctttccaacaaagtttgtttctcaacgcctttgccctgattgaatttttcaaagctgtactacgcctgattttttgcccaaacgtggcggagctgcgcccgttcacgattcaggacgagagcgcccgttactggagtcgtcgcctgagctggttaagcagcctgattggctatggcctgattgtggccgtgccgattatctctaatcaggtgaatgtacagataggtgcgctggcgaacgtcatcattatgctgtgcatgacggtctgggcgttgtacctgatctttcgtaataaaaaagagattacccagcatttgctcaacttcgcggagcattcgctggcctttttcagcctgtttatccgcgcctttgcgctggtgtggcactggctggcaagcgcctattttatcgtgctgtttttcttttcgttgttcgatccgggcaacagcctgaaatttatgatgggtgcaacggtgcgcagcctggcgattattggtatcgcagcatttgtttccggtatgttttcccgctggctggcgaaaaccatcactctctcgccacatactcagcgtaactatccggagctgcaaaaacggttgaatggctggctgtcggcggcgctgaaaacggcgcgtattctgaccgtctgcgtggcggtaatgttgctgttgagcgcatggggattgttcgatttctggaactggctgcaaaacggtgcggggcagaaaaccgtagatatcctgatccgtatcgcactcattcttttcttctcggcggttggctggacggtgctcgccagtttgatcgaaaaccggctggcttcggatattcatggccgcccgctacccagcgcccgtacgcgtaccctgctgacgctgttccgtaacgcgctggcggtgattatcagtaccatcaccatcatgattgtgttgtcggaaatcggcgtcaatatcgcaccattgctggcaggtgccggtgcattggggctggctatctcttttggttcgcaaacgctggtgaaagatattatcaccggcgtatttattcagtttgaaaacggcatgaacactggagatttggtgactatcgggccgttgaccggcacagtggaacggatgtcgattcgctccgtgggcgtgcgtcaggataccggggcgtatcacatcattccgtggtcttcgataaccacctttgctaacttcgtccgcggcattggttcggtggtggcaaattacgatgttgatcgccatgaagatgctgataaagccaatcaggcactgaaagatgcggtagctgaattgatggaaaacgaagaaattcgcgggttgattatcggtgaaccgaactttgccgggattgtcggcttaagcaataccgcatttacactgcgtgtttcgttcaccacgctgccactcaaacagtggacggtccgctttgccctcgacagccaggtgaaaaaacatttcgacctggcgggtgttcgcgcgccggtacagacttatcaggtgctgcctgctccgggcgcgtccccggctgaaccgctgccgccgggggagccaacgctttaacgttggcgattgacaaaacggcggcgctgctcgtcgttcataaaggtccaggcaataaagcgactctgcttttgcccctgggccatctcttttttaaccaccttcaccgcgccaacgtccgtcagggcacgatacaatggcggtaagttttcaccacgagataccagtgaggtaaaccacatcacctgcttcgcgaagcctttgctctcttcaatcatctttttgataaaagcgacttcaccgccttcacaccacaactcctgttgctgaccaccaaagttcagtacatcgtctttgttcagccccaagttacggcgtttacgttcactacctgcccgtgccgcagcggcggaatcgtggaatggcgggttacacaaggtcgcgtcgtattgctcgtttttatggatgatgccgttaaaaatcgccccactctctttttgccgacgcagacgaatggcgcggttaagccccggattagcactgatgatcgcctgcgcactgcttaacgcctggctgctggtttcactaccggtaaaacgccagccatattcatgtacgccaatcagcgggtaaatacagttcgcaccaacaccgatatccagaatgctggcattcgctggaattgatcctgttgcttctgccagtaaatcggcaaggtgatgaatataatccgcccggcccggtactggtgggcagagaaaaccgtcggggatatcccagttcgctacggcgtaaaaatgggccagcaacgccttattgagcgccttcaccgccagcggattggcaaagtctacgctttgctccccggcgggtgtaagcgtgaggaattgcctgagttcaggattgacctgacaaagcgtggcgagatcgtagcggctgtgatgacggttgcgcggatgcaaccccggtttctgggcggacatagcattctcctttaagcagcggcgtaagatacccgcataacgcgacagggtaaatatctggctgcgtttatcatttctataaaccttcacatggctatggtttatggcaattcatcataaaaatcatcattatgcatgtcattgatttgtcttgttttgtaaaaatatatcgttcaaaaaacaagcgcatctctgtcaattttttgcgtcattttcatcgcccaggcgacctacacttatcaggcactacccgttgtatttatgaggatgtcattatgaaaaagtgcctcacactactgattgccaccgtcctgagcggaatctctctcacggcttatgccgcgcaaccgatgagtaacctggacagcggtcagctacggcccgccggtaccgtttcggcaactggcgcatcaaacctaagcgatctggaggataaactggcagaaaaagcgcgcgagcaaggcgcgaaaggttatgtcattaattccgcgggcggaaatgaccagatgttcggtactgcaaccatctacaaataaccccaccaacgtaactgcattcgcctctggatgcagttttcgcctgttttgtaatcaaaaaacatcaaatatgaacgcaatgtaaataaatgtatttctttttcgcgcaatgggtgatagaaaatcgcgccaagtgataatgcttatcaaaattattatcacttgcacgaacgctatcacgagattaacagtggcatcgcatccgcagagaggctttctcgtggcagtgaaaatttcaacatataagaaaaagtcacctgcaaaatggaaaacaatcgcaatttccctgccagacaatttcattcgctcacgttctttgccggtctttgtattggcatcacgcctgtggctcaggcactcgccgccgaagggcaagcaaacgcggatgacacgctggttgtcgaagcatcaacgccttcgctttatgcgccacaacaatctgccgatccgaaattctcgcgtccggtagcggatactacccgcacgatgacggtgatttctgaacaagtgattaaagatcagggcgcaaccaaccttaccgacgcgctcaaaaacgtccccggcgtgggtgcgttttttgcgggtgagaacggtaactccaccactggcgacgccatttatatgcgcggtgccgatacctctaacagtatttatatcgatggcattcgcgatatcggcagcgtctcgcgcgacaccttcaataccgagcaggtcgaagtgattaaagggccgtccggcaccgactacgggcgcagcgcaccgacgggctcgatcaatatgatcagcaagcagccgcgcaatgattcgggcattgacgcctccgcgagtattggcagcgcctggttccgccgcggcacgctggacgtcaatcaggtcattggtgataccactgcggtgcgcctgaacgtgatgggcgaaaaaacgcacgatgccggacgcgacaaaatcaaaaatgagcgttacggcgtcgccccttctgtcgcttttggccttggtacagcgaatcgtttgtatcttaattatctgcatgtcacccagcacaacacgccagacggcggcattccgaccatcggtttaccgggttattctgccccatctgcgggaacagcggctctgaatcattccggaaaagttgatactcataacttttacggcacggattccgattacgacgattcgaccaccgacaccgctactatgcgttttgagcacgacatcaacgataacaccaccattcgcaatactacccgttggtcgcgcgtgaagcaggattacctgatgacggcgattatgggcggggcgtcgaatattacccagcccaccagcgatgtgaatagctggacctggtcacgcacggcgaatactaaagatgtgagtaataaaattctcaccaaccagaccaacctgacctcgacgttctataccggttctatcggtcatgatgtcagtaccggcgtggaatttacccgtgaaacgcagactaactacggcgttaatccggtgacgttacctgcggtaaatatttatcatcctgacagcagcattcatcccggcggcctgacgcgcaacggcgcaaacgccaatggtcagacggataccttcgcaatttacgccttcgatacgctgcaaatcacccgtgattttgagctgaacggcgggatccgtctggataattatcatactgaatatgacagtgccaccgcctgcggcggcagcggacgcggtgccatcacctgccctgctggcatggcaaaaggttctccggtcaccaccgtcgataccgctaagtcgggcaatctggtgaactggaaagccggggcgctgtatcacctgacggaaaacggcaatgtctatattaactatgccgtttcccagcagcctccgggcggcaacaacttcgcccttgcgcagtctggcagcggtaacagtgccaaccgcaccgattttaaaccacaaaaagccaacaccagcgagattggcaccaaatggcaggttctggataaacgcctgttgctcaccgccgcgctgttccgtactgatatcgaaaatgaagttgagcaaaatgatgacggaacttactcgcaatacggtaagaaacgcgtcgaaggctatgagatatccgtggccgggaatatcactcccgcgtggcaggtgattggcggctatacccagcaaaaagcaaccatcaaaaacggcaaagatgttgcccaggatggttcctcatcgctgccgtataccccggagcacgcctttaccttatggagccagtatcaggcaaccgatgatatctctgttggtgcgggcgcacgctatatcggcagtatgcataaaggttctgacggcgcggtgggaacgccagcgtttaccgaaggttattgggtcgccgacgctaaactggggtatcgggttaatcgcaatctcgacttccagctaaacgtctacaacctgtttgataccgattacgtcgcctcaatcaacaagagcggctaccgttatcacccgggcgagccaagaaccttcttgctcacggccaatatgcatttctgattcagatgtggggcgcaggccccactttttggagaacttgtatgatgtaccacattcccggcgtgctatcgccaaaggacgtcgcccgttttcgcgaacaactggaacaagccgaatgggtggatggacgcgtcaccaccggcgcacaaggtgcgcaagttaagaacaatcaacaggtagacacccgcagcgcgttatacgccgcactgcaaaatgaggtgctgaacgcggttaaccaacatgcattgttctttgccgctgccttgccgcataccctttccacgccgctgtttaatcgctatcagaacaatgaaacttatggttttcatgtggatggcgcagtacgcagtcacccacaaaacggctggatgcgcactgacctttctgccacgctgtttttaagcgatccacaaagctacgacggcggcgaactggtcgttaatgacaccttcgggcaacatcgggtaaaacttccggcaggcgatctggtgttgtatccctccagcagcctgcattgcgtgacgcccgtaacccgcggcgtacgagtggcatcatttatgtggatccagtcgatgatccgcgatgataaaaagcgcgccatgctgttcgatctggacaacaatattcagtcgctgaaaagccgctacggcgaaagtgaagagatcctgtcgctgctcaatctttatcataatctgctgcgggaatggtcggagatctgacgcttgaactgcccgagttcgtccctatattagctacacttaactgtacaagtattgatatggggaggacgatatggcatccggttgggctaacgatgacgccgtcaacgaacagatcaacagtacaattgaagatgcgattgcccgcgctcggggtgaaattccgcgtggtgaaagcctgtatgaatgtgaagagtgcggagcccccatcccgcaagcccgtcgggaagccattcctggtgtgcgcttatgcattcattgtcagcaggagaaagatttacaaaaaccagcttatacaggatataatcgcagaggttcgaaagacagccagttacgttaactacaactggcgggatgtatagcgagtataatttgtattttgcgtggcattccgtgcctttaacgctgtcgtgactgccacgctgcataaaacaagtccataagttcaacaaataaatgggttatcagtatgttagatatcaatcaatttatttgaacaaggcggtcaattctcttcgattttatctctcgtaaaaaaacgtgatactcatcacatcgacgaaacaacgtcacttatacaaaaatcacctgcgagagattaattatgaaaactatcaatactgttgttgctgctatggctctgtcaactttgtcatttggcgtgtttgccgcggaaccggtaacggcatcccaggcacagaacatgaataaaatcggcgtggtttctgccgatggcgcatccaccctcgatgccctggaagcgaaactggctgagaaagcggcggcagccggtgctagtggatacagcatcacttctgccaccaacaccaataaattaagtggtactgcggtaatttataagtaattcgtaggacggataaggcgtttacgccgcatccggcaacagatgcctgatgcgacgctaccgcgtcttatcagacctacaaaatccgaaccgttggctggatcaggcgtttacgctacgtccagcacaagtatttccctgtctgtttgccgacagacgcatatgctctaaccctcattgatcctatgttacccttgtttgcccgtccgccactggacgggcttttttttagctggctaactgctgacagaaagcctgcaacgtctcttccggcataccaatctgccgcgccgcatcacaaatggcctgccagcttcccgcatccaatggaatcccctgctcctgccgttcgagacgcgtgttaacttcccactcgcccggtagcaaaatcggcttatcgtcatcatgcggcgaggctttcacccactcggcaaaggcttcggtctgcgcgctacaatccggcgcgccgaacagctccggattgatgatgatggtggtcatgcagttaagaatggcatcggggctggtttgcaacgtttcctgatgcgtcgttttaccgccagaaagcgccccaccaagaatttcacacattgctgcaagggcgtagcctttatgttcggcaaaggtcaacagcgaacccaacggcgactcctgcattaccgccggattggtcgtcggcacgccgttaacgtcaatcaggcaacctggcggcacggggatgcctttatgccaggcgacgcgggttttgccaaatgcgatggcgctggtggcgtaatcaagcaacagcgggaaattatctttacgagggaaaaccacacagaacggattggtgccaaagcggctgtcgcgaccgtggaacggcgcgaccattggaataccgaccacgctaacaaagtggatagagacaaaccccgctgctgcacactgctccgcccagtaaccgatacggccgatatgatgcgagttatgtagcgccacggcagcaataccgtgctgatgcgctttctcaatccccagcgccatcgcttcgtgtgctgcgacctgaccaaatgcgcgatcgccatcgagcgtgaccgccgcccccgcctctttaacgattttggcatggtggttaattcgcagatgcccctgactccaggaacgcacatagcttgggatcatgccaataccatgtgaatcatgccctgccaggtttgccgctattaaatgatcggcaactaatttcgcttcttgttcctcgctacccatctgacgaaatacagcctgaataaaactgtgcaacgtctgagcatcaaagcgatgaccactttccatggttaactcctgtttatgttatgtgtttgttgtttttttatgctgcacgccgggcgcgggaaggtcaataaagatgcaggaatttcatattacggtggggtaaaagccggatgacgtggctcatccggctgagataaaaattaaaatgcctgattaacgcgcgccaggccatcgctgatagttgccgcttcccccgtagccaccaggcagcaagccatctggattttcagcgattcgggaatcggttcgctgccagccaggcaacgctcaatccactgcgccgtggtttccggatcttttgcttgcggcagtaactcgctaccagcagggtcctgtttttcatacagcacccgcatcccttcatggtcgatcaaattgatctgcgggcagcgttgcggattagcatacacttcaccttcagtaccatgcattagtaacgcccgcccgccgatatcgctaaagaacttcgcgacgcgtccaatgtattccggatgcgaaacgctggaaagacgcagtgcctcaccttcggcaaatggcgtcgccagtttcgccagggtatgtgcactgttacgcacgcccatccgccagcgcatcgccagttgtttttccagcggcgggcaaaacgcgccgacaggcataaacaccggttgatgttcgtcgagcttcgcctgcgcctgcccgccgtgcaacgttggcgtaatacccatcagttcgaaaatggtttctgtcagcacgcgggttggatcttcgctaaccccgtgaaccaccacaggaaaaccgagtttgtgcaggagaatcgccaacaacggcgtcaggttggcctgtttacgcgcgccgttgtaactggggatgacaatcggcatcggcttgtctgcaggcggcgtcagcttgatggtgtgattttgcatggcttcgtaaaagccgagcatctctgcttccccttcccctttgatacgcagcgcaatcaatacgccgcccaactcaaggtcagggacttcaccattgagcatatgggcatacaggccgcgcgcagtatcccggtctaaatcgcgcgcgtggtttttcccgcgcccgatctctttaatgattttgcgatagtccatttacgactccttacctgactcacatcattaacgccgccgacggcgtggggatttcgttttttctttctttttaactataccttcagggacttccggttgctctatcggaaataccggtaatgcatccagtagccgcttgccgtagtttttggtgagcaagcgtttatcgtaaatcaccacttcgccccagcaaccgtggcttcgaatcagtcgcccaacctgctgaatcaggttaaacgaggcactcggcaggctttgcacctcaaacggatagcggttgaggcttttcagccattccccttcggtgatcaccaccgggctgtcgatgggcggaaaagcgattttgtggatatgcacctggctgagcagatcacctttcaaatcaagtccttcggcaaaggactgtaagcccaccagcacactacgctcaccgttggcaacgcgtttgcggtgcagttcaactaagcgataacgcggctgatcgccctgcaccagcaacatcaggcgtaaatccgtcacatagtcgagaaaccgctgcatcgcccgtccgctggcaaacagtaccaacataccgagatgttttttgctctccacctgctcacggaaaaaggctgccatttcagcaatgtgctgctcttcgttgtcgatggaaggctcaacgcgcatccggggaataacaattttgccctgttcgcagtggttaaagggggaatccagcgccacaaaacggtcgcccgctttctctttcagcccgctcatctcctgcaaacgcgaaaaactgttcagcgaacgtaaggtcgcggaagtgataataatgtgcggaatactgcgccacagcagcctttccagctgatcgctgacacgaatacccacacagtgaaaccagagatgtagctgcccttcgcgctcttcccgcgtcgcccatttggtcaccggcgcaccggaagattgcgccagagacgccagccgccagagtttgctttgcgcctcgaacatccccagcgcgcggttcatctgcaaaatcaaccgatgcagacgtacaatgtcatggctgccggttttctcacttaaatcgttaagaaataactccgccagaccacgcagcatctcggtgagttttgccagccgctggcagatctccagcacttcatcaggtagtacgcccatcgcaaaacggtgttctgcctcctgcccggcaggcatgtagagattgagaatgttgtttaacgaggcgataagctcatacaactcttcacaatgcgcattcaaacgctcggggatcgccagcggtgggatggtcttcgggcgaaactgctccatacaggtagcgaccagtttcgtgaacaagtccagttgcagccgataccagggcgcggtgatttcggcgctcatctccagcgcatcccgcgccacatccggcaggtgatgaccttcgtccagcaccagcagtaaatttttcgggtcaggcaatacggcttcgctttccatcgccgccatcaccagcgcatggtttgccaccaccacttccgcttcctgaatctcccgacgagcgacaaaaaacgggcattcgcgatagtaataacagttgcggttgaggcagctggctttgtcggtacttaaacgacgccagagatcgtcatctatagcaatatccgtatgatcgcgcagaccatcccatttataagtatcgagatcgcccttaagtttcgcacaacgtttttgctcttcctgattatttggcgtcagttcgtcgtcaagaaacgccagcagatcctgttgcgtgggttcagtactggcaagcgccgtcagattacgcgggcaaacgtagcgcccacgcccaaaagcggcagtgaatttaagatcgggaatgatctttttcagcagcggtaaatctttgctgtaaatctgatcctgcaacgccacgttggcggtactcaccaccagcgttttttgctcttcgcgggcaatggcgatgccggggatcaaataggagagcgttttcccaacgccggtgggagcttcaatcgccagatgccgcccttcttctccggccagcgttttggcgacgtccgcaatcatctgccgctgcggcgcacggggaataaagtcggggatctgttcctgaagcgccttataccaggcggcaatttgcgctttaagcgcggcggttaatgccatgagaaaacctgaaatactgtataaacagccaatattgtggcatttttcggttttcaggggtaatggtttttctgtttctggaaagcgactcgcaataaccaccaacataatgcggtttaatgcccgttcgagcacaaaggatccaacacgtcatgcaagacaccaccataaatttctacagcaccggcgatgactacggtgatttttctaactttgccgcctggcccattaaggttgacgggaaaacctggcccacctcagaacactatttccaggcacaaaaattccttgatgaaaaataccgcgaagagatccgtcgggtttcttcccctatggtcgccgctcgcatggggcgtgatcgttccaagccacttcgtaaaaactgggagtcggtcaaagaacaggtgatgcgaaaagcgcttcgcgctaaattcgaacaacatgcagaactgcgtgcgctcttgctggcaaccgcgtccgcaaaactggttgagcatacggaaaatgatgcttactggggagacggtggtaatggtaagggcaagaatcgactgggctaccttttaatggagttgcgtgaacaattggctatagagaagtaacatctcgggtgacttatgggcgataaaacagagaaatctttttgccgcgttctcaaattgctgacaagtgcttgttgtgaaatgccggatgcggcgcaaacgccttatccggcctacaaaagcatgcaaattcaatatattgcagagttcatgtaggcctgataagcgtagcgcatcaggcagttttgcgtttgccatcaggctcagttgccgggcatagcccggcatcaaaagattactgcgcagcggcaggtttacgcggacggcggcgacgttgttgttcgcctgccggtttggcatcgccgaggcgacgagacggtttttctccaggtttagcgcttgcagattttgcgccaccttctccacggcgtggttgctgttgaccgcgaccaccaccttgcccacgaccgccgccgccacgttgctggcgaccgttctggattggttcggctttgattgacgggtccggctcatagcccggaatcgcaatgcgcgggatctcttttttcagcagtttttcgatatcacgcagcagtttgtgttcatcaacacacaccagcgacaacgcttcaccggtagcagccgcacgaccggtacgcccgatacggtggacataatcttccggtacgtttggcagttcatagttgaccacgtgcggcagctcttcaatatccaggccgcgcgcagcgatgtcagttgccaccagtacacgaatatcgcccgatttaaaatcagccagcgcacgggtacgcgcaccttgcgatttattgccgtggatcgccgcactgcggatgccatctttattgagctgttcagccagatggttagcgccatgtttggtacgggtaaacaccagcacctgctgccagttccctttcccaatcatgtgcgacaacaattcgcgtttgcgtttcttatcaacaaagtgaacatgctgggtcacctgatcagacgcggtattgcggcgtgccacttcgatttccagcgggttgtgcaacagtttttccgccagagctttaatatcgtcagagaaggtcgcggagaacaacaggttctggcgcttcgcaggtagttttgttaacacgcgacggatatcgtggataaagcccatgtcgagcatgcggtcagcttcatcgaggacgaggatttcaacctgatccagcttcaccgcattctgatgttccaggtccagcagacgtcccggcgttgccaccagcacatcaacgccgccgcgcaacttcatcatctgcgggttaatgctgacaccgccaaacaccaccagcgaacgaatgttcaggtatttgctgtaatcacggacgttttcgccaatctgcgccgccagttcacgggtcggggtaagaatgagcgcacgtaccggacgacgccctttggcgtgcggctggcgagtaatcaggtgttgcaacagcggcagcgtaaagcccgctgttttgccggtgccggtctgggcactggccatcaggtcgcggccttccatcaccgcagggatcgcctgctgctgaataggggtgggttcacggtaaccctgctcggcaacggcgcgcaggatatcagggcttaaacccaaagaatcgaaagacataactactccgaaccgccccgaccgttaccggtgtagttttcagggagatactgaaaaggaaaatgacaaaaaccacaatgtcatgagggagcggagtgtagcagtttttgtgacgcagcgcataaattatccctgtgactggcgttgctaaaattcttagccatactggacaactctcatatggagtcataatcttaatcaatcatttgattaagaatggactgtgcgatgaataatcctgccatgacaatcaagggtgaacaggcgaaaaaacagctgattgctgccgcactggcgcagtttggtgaatatggaatgaacgccaccacccgcgagatagccgcccaggccgggcagaatatcgctgccatcacctactacttcggttcgaaagaggatttgtacctcgcctgcgcccagtggattgccgattttattggcgagcagttccgtccgcacgccgaagaggccgaacgcttgttcgcacaaccacagccagatcgggctgccatccgtgaactgatccttcgcgcctgcaggaacatgattaagctgctcacccaggatgacactgtcaacctcagcaagtttatctcccgtgagcagctctctcccacggcagcctaccacctggtgcacgaacaggtgattagtccgctacacagccacctgacacgcctgattgccgcctggaccggctgcgacgccaatgacacccgcatgatccttcatacccatgcgttgattggtgagattctggcgtttcgtcttggcaaagaaacaattctgttacgtaccggctggaccgcgttcgatgaagaaaagaccgaactgatcaaccagacggtgacctgtcatatcgacctgattttgcaaggattatcgcaaaggagtttgtagtgatgaaaaaacctgtcgtgatcggactggcggtagtagtacttgccgccgtggttgccggaggctactggtggtatcaaagccgccaggataacggcctgacgctgtatggcaacgtggatattcgtacggtgaatcttagtttccgtgttggggggcgcgttgaatcgctggcggtggacgaaggtgatgctatcaaagcgggccaggtgctgggcgaactggatcacaagccgtatgagattgccctgatgcaggcgaaagcgggcgtttcggtggcgcaggcgcagtatgacctgatgcttgccgggtatcgcgatgaagaaatcgctcaggccgccgcagcggtgaaacaggcgcaagctgcctatgactatgcgcagaacttctacaaccgccagcaaggactgtggaaaagccgcaccatttcggcaaatgacctggaaaatgcccgctcctcgcgcgaccaggcgcaggcaacgctgaaatcggcacaggataaattgcgtcagtaccgttccggtaaccgcgaacaggatatcgcccaggcaaaagccagcctcgaacaggcgcaggcgcaactggcgcaggcggagctgaatttacaggactcaacgttgatagccccgtctgatggcacgctgttaacgcgcgcggtggagccaggcacggttctcaatgaaggtggcacggtgtttaccgtctcgctgacgcgtccggtgtgggtacgcgcctatgttgatgaacgtaatcttgaccaggcccagccggggcgcaaagtgttgctttataccgatggtcgcccggacaagccgtatcacgggcagattggtttcgtttcaccgactgctgaatttaccccgaaaaccgtcgaaacgccggatctgcgtaccgacctcgtctatcgcctgcgtattgtggtgaccgacgccgatgatgcgttacgccagggcatgccagtgacggtacaattcggtgacgaggcaggacatgaatgatgccgttatcacgctgaacggcctggaaaaacgctttccgggcatggacaagcccgccgtcgcgccgctcgattgcaccattcatgccggttatgtgacgggactggtagggccagacggtgcgggcaaaaccacgctgatgcggatgctggcgggattactgaaacccgacagcggcagtgccacagtgattggctttgatccaatcaaaaacgacggcgcgctgcacgccgtgctcggctatatgccgcagaaattcggtctgtatgaagatctgacggtgatggagaacctcaatctgtacgcggatttgcgcagcgtcaccggcgaggcacggaagcaaacttttgctcgcctgctggagtttacatctcttggcccgtttaccggacgcctggcgggcaagctctccggtgggatgaaacaaaaacttggcctggcctgtaccctggtgggcgaaccgaaagtgttgctgctcgatgaacccggcgtcggcgttgaccctatctcacggcgcgaactgtggcagatggtgcatgagctggcaggcgaagggatgttaatcctctggagtacctcgtatctcgacgaagccgagcagtgccgtgacgtgttactgatgaacgaaggtgaattgttgtaccagggagaaccgacggccctgacacaaaccatggccggacgcagctttctgatgaccagcccgcacgagggcaaccgcaaactgttgcaacgcgccttgaaactgccgcaggtcagcgacggcatgattcaggggaaatcggtacgactgatcctcaaaaaagagaccacaccagacgatattcgccatgccgacgggatgccggaaatcaacatcaacgaaactacgccacgttttgaagatgcgtttattgatttgctgggcggtgccggaacctcggaatcgccgctgggcgcaatattacatacggtagaaggcacacccggcgagacggtgatcgaagcgaaggaactaaccaagaaatttggtgattttgccgccaccgatcacgtcaactttgccgttaaacgcggggagatttttggtttgctgggaccaaacggcgcgggtaaatcgaccacctttaagatgatgtgcggtttgctggtaccgacctctggccaggcgctggtgctgggcatggatctgaaagagagttccggtaaagcgcgccagcatctcggctatatggcgcaaaaattttcgctctacggcaacctgacggtcgaacagaatttacgctttttctctggtgtgtatggcttacgcggtcgggcgcagaacgaaaaaatctcccgtatgagcgaggcgttcggcctgaaaagtatcgcctcccacgcgaccgatgaactgccattaggttttaaacagcggctggcactggcctgctcgctgatgcatgaaccggacattctgtttctcgacgaaccgacgtccggcgttgatcccatcacccgccgtgaattttggctacatatcaacagtatggtagagaaaggcgtcacggtgatggtcaccacccactttatggatgaagcggaatattgcgaccgcatcggcctggtgtaccgcgggaaattaatcgccagcggcacaccggacgatttgaaagcgcagtcggccaacgatgagcaacccgatcccactatggagcaagcctttattcagttgatccacgactgggataaggagcatagcaatgagtaatccgatcctgtcctggcgtcgcgtgcgggcgctgtgcgtcaaagagacacggcagatcgttcgcgatccgagtagctggctgattgcggtagtgatccctctgctgctgctgtttatttttggctacggcattaacctcgactccagcaagctgcgggtcgggatattgctggaacagcgtagcgaagcggcgctggatttcacccacaccatgacaggttcgccctacatcgacgccaccatcagcgataaccgtcaggaactgatcgccaaaatgcaggcggggaaaattcgcggtctggtggttattccggtggatttcgccgaacagatggagcgcgccaacgccaccgcaccgattcaggtgatcaccgacggcagtgagccgaataccgctaactttgtgcaggggtatgtcgaagggatctggcagatctggcaaatgcagcgagcggaggacaacgggcagacttttgaaccgcttattgatgtacaaacccgctactggtttaacccggcggcgattagccagcacttcattatccccggtgcggtgaccatcatcatgacggtcatcggcgcgattctcacctcgctggtggtggcgcgagaatgggaacgcggcaccatggaggctctgctctctacggagattacccgcacggaactgctgctgtgtaagctcataccctactatttcctcgggatgctggcgatgttgctgtgtatgctggtgtcggtgtttattctcggcgtgccgtatcgcgggtcgctgctgattctgttttttatctccagcctgtttttactcagtaccctggggatggggctgcttatttccacgattacccgcaaccagttcaatgccgctcaggtcgccctgaacgcggcttttctgccgtcgattatgctttccggctttatttttcagatcgacagtatgcccgcggtgatccgcgcggtgacgtacattattcccgcacgttatttcgtcagcaccctgcaaagcctgtttctcgccgggaatattccggtggtgctggtggtgaacgtactgtttttgatcgcttcggcggtgatgtttatcggcctgacgtggctgaaaaccaaacgtcggctggattagggagaagagcatgtttcatcgcttatggacgttaatccgcaaagagttgcagtcgctgctgcgcgaaccgcaaacccgtgcgattcttattttacccgtgctgattcaggtgatcctgttcccgttcgccgccacgctggaagtgactaacgccaccatcgccatctacgatgaagataacggcgagcattcggtggagctgacccaacgttttgcccgcgccagcgcctttactcatgtgctgctgctgaaaagcccacaggagatccgcccaaccatcgacacacaaaaggcgttactactggtgcgtttcccggctgacttctcgcgcaaactggataccttccagaccgcgccgttgcagttgatcctcgacgggcgtaactccaacagtgcgcaaattgccgccaactacctgcaacagatcgtcaaaaattatcagcaggagctgctggaaggaaaaccgaaacctaacaacagcgagctggtggtacgcaactggtataacccgaatctcgactacaaatggtttgtggtgccgtcgctgatcgccatgatcaccactatcggcgtaatgatcgtcacttcactttctgttgcccgcgaacgtgaacaaggtacgctcgatcagctactggtttcgccgctcaccacctggcagatcttcatcggcaaggccgtaccggcattaattgtcgccaccttccaggccaccattgtgctggcgattggtatctgggcgtatcaaatccccttcgccggatcgctggcgctgttctactttacgatggtgatttacggtttatcgctggtgggattcggtctgttgatttcatcactctgctcgacacaacagcaggcgtttatcggcgtgtttgtttttatgatgcccgccattctcctttccggttacgtttctccggtggaaaacatgccagtatggctgcaaaacctgacgtggattaaccctattcgccactttacggacattaccaagcagatttatttgaaggatgcgagtctggatattgtgtggaatagtttgtggccgctactggtgataacggccacgacagggtcagcggcgtacgcgatgtttagacgtaaggtgatgtaacttcttatctttcgccagcaaagacaccaccgccgggccggcaaggattgccagccctgcaatcgccagcaaaaagttgttttccagtacgcgggacaacagccacagcacaatcagcgctgcgccaaaataccaggtcgtggtcagctcttccagcacgtctgccacctcacgccagcgttgctcggggtggcgctgaaacaccagcatcatcactaccgtgacacaatacagtgcgcataatcccacgccgacgtgaaccagagtcttactcatccagcccaccaccagcagcgccactaccagtaaatgcaacataatctgccagcaacttagacccgttgcgacacgaacacgttgttgccacttcatggcttctctcctgaagaatttatctctacttactcagagtaccgaactttacggaaaattccgtaagaccgcacctttttgtgacgccgactacactatttcaatgagataagaggcaaagacaggaaaattatgcccgatcaaacacaacaattttcgttcaaggtgctcaccatcaatattcacaaaggctttaccgcgtttaaccgacgcttcattttgccggaacttcgcgacgccgtgcgtaccgtcagcgccgatattgtttgcctgcaggaagtgatgggcgcgcacgaagttcatccgctgcatgtggaaaactggcccgatacctcgcactacgagtttctcgccgacactatgtggagcgattttgcctacggtcgcaatgccgtatacccggaaggacatcacggtaacgccgttctttcacgttatcccattgaacattatgagaatcgtgatgtttcggtcgatggtgcggaaaagcgcggcgtgctctactgccgcattgtgccgccgatgaccgggaaagcgattcatgtgatgtgcgtacatctgggcctgcgtgaggcgcaccgtcaggcgcagcttgcgatgctcgccgaatgggtgaatgagctgccggacggcgaaccggtattggtggcgggtgatttcaacgactggcggcaaaaagctaatcatccgttaaaagtgcaggccgggctggatgagatatttacccgcgcccacggacgcccggcgcgcacgtttccggtgcaatttcctctactacgtctggacaggatctatgtcaaaaatgccagcgccagcgcgccaaccgcgttgccgctgcggacatggcgacacctttctgatcatgcccctttaagtgcggagattcatttatgaaatgtagctggcgcgaaggcaataagatccagttgctggaaaacggcgagcaatattatcccgcggtgtttaaggcgattggcgaggcgcaagaacgcatcattcttgaaacgtttatctggtttgaagatgacgtcggcaaacagctgcatgcggcgctactggcagcagcgcaacgcggggtgaaagcggaagtcttgctggatggctacggttcgccggatctcagcgatgagtttgtcaatgaattgacggcagctggcgtggtatttcgctactacgatccccgccctcgcctttttggtatgcgcaccaatgtgtttcgccggatgcatcgcaaaattgtggtgatcgacgcgcgtattgcctttattggcgggctgaactactccgccgagcatatgtccagctacggtccggaggctaaacaggattacgcggtgcgccttgaagggccgattgtcgaagatattctgcaatttgaactggaaaacctgccaggacagagcgcggcacgacgctggtggcgacgtcatcacaaagcggaagagaaccgccagccgggagaagcgcaggtattgctggtctggcgcgataacgaagaacatcgcgatgatattgaacgtcactatctgaaaatgctcactcaggcgcggcgagaagtcattatcgccaacgcctacttcttccccggctatcgatttttacacgccttgcgtaaagcggcacggcgcggggtgcggatcaaactgatcattcagggcgaaccggatatgccgattgtcagagtcggtgcacgcttgctgtataactatctggttaaaggcggcgttcaggtgtttgagtaccgccgccgtccgctacatggcaaagtggcattgatggacgatcactgggcgacggtagggtccagtaatctcgatccgctcagtttgtcactgaatctcgaagcaaatgtcatcatccacgatcgtcattttaaccagacgctgcgcgataatctgaacggcattatcgccgcagactgccagcaggtggatgaaaccatgctgccgaaacgcacctggtggaatctgaccaaaagcgtgctggccttccactttttacgccacttcccggcgctggtcggctggcttccggcacacacaccacgtctggcgcaggttgacccgcccgctcagccgacaatggaaacgcaggatcgggtagaaactgaaaacacgggggtaaaaccctgatgagtaaatcacacccgcgctggcgcttagcaaagaagatcctcacctggctgttttttatcgcggtgattgtgttgctggtggtctacgccaaaaaggtggactgggaagaggtctggaaggtcatccgcgactacaatcgcgttgcgttgctcagtgcggtcgggctggtggtcgtcagttatctgatttacggctgctatgatctgctcgcccgcttttactgcggtcacaaactggcgaagcgccaggtgatgctggtgtcgtttatctgctacgccttcaacctgacgctcagtacctgggtcggcggcattggtatgcgctatcgtttgtactcccggctagggttaccgggcagcactattacgcggattttctcgctcagtattaccaccaactggctgggctatattttgctggcagggattatctttaccgcgggcgtggtggagctgccggatcactggtatgtcgatcaaactacgctgcgtattctcggcattggcttactgatgattatcgcggtttatttgtggttttgcgctttcgcgaagcaccgccatatgaccatcaaagggcaaaagctggtgctgccttcatggaaattcgccctcgctcagatgctgatttccagcgttaactggatggtaatgggggcgattatctggctgttacttggtcaaagcgtgaactatttctttgtactgggcgtgttactggttagtagtattgctggcgtcatcgtgcatattccggcgggaattggtgtgctggaagcggtatttatcgcgctactggctggggagcatacctccaaaggtacaattatcgccgccctactcgcttaccgtgtgctgtattactttatcccactgctgctggcgctgatctgttacctgctactggaaagccaggcgaagaagctgcgggcgaaaaatgaagcggcgatgtgaagtttagttaagttctttagtatgtgcatttacgactaatgaaaaaaacgcgtatgcctttgccagacaagcgttatcgctattgctgcaagtatcccaaagaagccgataaaatagtaatagagagttaatgcacctgtaaaagcgcaacgaaccggactccacaactcttcactatggcatttccccgccagttcaaggagcttatttcgtccatgcgagataatgcctgaccataacacaatcattaagcaacttattacccaaacgggtcgttcactcattaatgcggcattcatgatgatcaccagggccagccctgcggttgccaccatacccaaagcggtaatgagccatatgccgtttaatatcctggcttcgtgctgaaaatctaatttattgctgttttgcgagtatgattccattcttttagttatccttagataaaatattaatattcaccatcaataaatttaaaaccacgcatacaaaatacttttgtatttatggatacggaaaacacttccgctcggccataaggcatattttatacctggtacttgttaagtgtcgtttttagtaagaaaaaaatcccgacacatggccgggatattgatggtgaaaaagaattaacggcggttgccgaagatccgcaacaacatcaggaacaagttgatgaagtccagatacaaggttaacgcgccaagaatggaatatttgcgcaggttcgacgtgtcgcgggtatcaatctgctcacccatatttttcaatttctgagtgtcatacgccgtcaatccgacaaagacaatcacgccgatgtaggtaactgcccacatcaatgcttcgcttttcagccagaagttgaccagcgatgccagcacaatgccgattaacgccataaacagcatattgccaaagccgcttagatcgcgcttcgtggtgtaaccgtacaggctcattgcgccaaacatcccggcagtaacgacgaaagtactggcgatagaagcagcggtatagacaatgaaaatactggaaagcgtaagacccgtcagcgccgaataaagcataaagagcatcgtcgttacacctgcgctcagcttttgaatcatcgctgataacacaataaccaatgctaattgcgcgatgatcagaccgattaaaaagacacggttagtgaacaacagctccatcacggccgcggaattagccgcataccaggcaacaaatgcggtcagcaacaagccaacggtcatccagccatagacttgcgccatataagtttgcaagccagcccggggttgtacaattgaatcagaacgtgggaatctgtccatgacgatctcctgaagatataaggaatatcttaaggatactgcaaaatgatgaggctgtgcatcgacgcagcgtaaacgcatgtactgagcggtgaaattgccggacgcagcggtgccttatccggctaacaaaaaactaccagcgttttgccgcctgctgatcgctctcccgagcttcaacccagcggtcgccttccggcgtggcttcacgcttccagaacggtgcgcgggttttgagataatccataataaactgcccggcttcaaacgcactgctgcgatgcgcactggtgacaccgacaaaaacgatttcatctcccggccataattccccgatgcggtgaatcaccgtgatgcgccccagcggccagcggttacgcgcttcatcgacaatttctgccagtgctttttcagtcatccccggatagtgttcgagggttaatgctttgacgctgtcgccaaggttatggttgcgcaccttaccggtaaaggtgactaccgcaccgtcttcatcacgctcagccagccacgggtactcttctcctacgctgaatggctgcgggccgacaacaattttggtttctgccatcttaacctccggttaccggcgggaagaaagccacttcgtcgccgtcagtcagcggatggtcaaaactcaccagcgtctggttgacggcagccagcaatttgccatcttccagcgccagcgcccagcgatcgctctgcgcagccagatgttggcgtaacgcttcaacggttgggaaatccgcagccacttcggttgcatctgttcccaccaactcgcgcacctgggcgaaaaaaagaactttaatcatccgcttccaccttaaagtcacccgacttgccgccactcttcgccagcaaacgtaccggaccaattaccatatctttttgcaccgctttgcacatgtcataaatggttagcgccgccacggaggccgcggttaacgcttccatttcgacaccggttttcccggtcaggcggcataaggtttctatacgcacccgattgtgctccggctcagcctgtaaattgacttcaactttgctgagcatcagcggatgacacagcgggatcagatcccaggtgcgttttgccgcctgaataccggcaatacgcgcagtggcaaatacgtcgcctttatggtggcgaccatcaataatcatcgccagcgtctcgctgcgcatggtgacaaaggcttccgcccgtgcttcacgcacggtttccgctttggcggagacatccaccatgtgcgcttcgccagcggcgttgatatgggtcagttgcgacatacttatttcttcaaatgtggatggaaattgcatggacgtgtacgggcatcgagctgcggcgcgatgatattttcccacgcggtgcggcacgctttggtcgaacccggcatggcgaaaatcagcgttttgttagcgacgcccgctaccgcacgagattgcaacgtggaagtgccaatctcttcgaacgacaacatccggaacacttcaccaaaaccttcaacttcacggtcgaacaacggcagcagcgcttcgggagcctgatctccttccgtcaggccagtcccccccgtaatcaataccacttgtacatcgtcgctggcgatccacgcagatacctgagcgcgaatagcgtagcggttttctttcacaatggctttatcgacaacgtgatggcccgcttcctgcgccgaatcgcgcagatagtgaccggaggtatcgtcttcttcaccgcgacgattagaaaccgtaagaatagcaatacgggtcgggataaattcagtgcttacctgactcatctgatctctccttttgacgttttagccgccaatgtacgataagttttgcgtaataccggtgttgttttgatgcaggaaatgggtctgtttcttctcccgcagcgccgctgaaatacgcgcttccagcgcctgttgctgggtatcgtcttccagcagatcgcgcaggttaacgccgccttcaccaaacaggcagagatggagtttaccaatggaggaaacgcgcaggcggttgcaagtggcgcagaagtctttttcatacggcatgataaggccaatctctccggcgtaatccggatgacaaaagacttgcgcgggaccgtcactgcgttgacgtaattggtggatccagccgcgacgcagtagctcgtcacgcagaacctgaccagagatgtgatgcttacggaagagctcgctgccctcgcccgtttccatcaattcgatgaaacgcagctggatagggcgatgctggatccagttcagaaaggtgtcgagctgatgatgattaacatcacgcatcagcacggtattgactttgaccttctcaaaaccggcctcaaatgcagcatcgatccctgccatgacctggttgaatttatcctgcccggtaatggcatgaaactggcgagcgtcaaggctatcaacgctgacgttgatgccagtaagtcccgcatcgcgccagttcgccacatcgcgttccagacggtaaccattggtggtgaccgcaatctggcggatagcgtcgttttcccgcacagcggcgatgatatcggtaaagtcgcggcgtaaagacggctcaccgcctgtcaggcgcactttttcggtgcccagactggcaaaggcgcgcgtaacccggcgaatttcatcgacggtaagaaagcctttattggtgacgccgctcggtttgtagccatccggcaggcagtaggtgcaacgaaagttacacacatcagtaatcgacaggcgcaagtagtagtacttacgcgcaaatgcatcagtcagttgtgaagccatgtacacctttccagatacgggaggcgaagtcatttctttcttcgccctggtggcaatctttacgagcattgtcacggccaaagcaccgtatcagttgacccaggtgcagaggctagagtgtttagtggttaagccgatactagcgtgtaaatgagatttttaccatccacactttcgctatgtaatcatgtatatagcgtcatgatcgtgctatttcgctacagaataagggaaaatggcggttttactttgatatacatcatcagagaggcatagcgtgcttcatcctttagaggtagaagaaaatagtttgtatcctcaatattggcaggttaattgctgtttccccgcaatttgcgctactgtagcgcggataatctgactccaggaaactatatgcgcaatcgtacgctggctgatcttgatcgtgtcgttgctctcggcggagggcatggactgggacgcgttctctcatcactttcgtctttgggttctcgtttaacgggtatcgtcaccaccacggataatggcggatcgacggggcgtattcgccgctcagaaggcggtattgcctggggcgatatgcgtaactgcctcaaccagctgataactgaacccagcgtcgcttccgcaatgtttgaatatcgtttcggcggtaatggcgaactttccggacacaaccttggaaacctgatgctgaaggcactggatcaccttagcgtgcgacctcttgaagcgatcaatctgattcgcaatctgctgaaagtggacgcacatttgattccgatgtcggagcatccggtggatctgatggcgattgacgatcaggggcatgaagtttacggcgaggtcaatatcgaccagttaactacgccgattcaggagttactgttaacgccgaatgtacccgcaacgcgtgaggctgttcacgctatcaatgaagcggatctcatcattattgggcctggcagtttttatacaagcctgatgccaattctgctgctgaaggaaatcgcacaggcattacgccgcacgccagcgccgatggtctatatcggcaatctggggcgtgagttgagtttacctgcggctaatttgaagctggaaagcaagctggcaattatggagcagtatgtcggtaaaaaggtcattgatgcggtcatcgtcgggccaaaagtggatgcctcggcggtgaaagagcggattgtgattcaggaggtactggaggccagcgatattccgtatcgtcatgaccgccagttgttacataacgcactggaaaaggcgttacaagcactgggttaatgtggccgagattgctgaccaggcttctggtgcaatgcgacctgttcccctcaccctctccccggagggacgaggggaccgttcgagcacttttttgacttgatcgttaatctgaaccggaagaacattccggctttttcatcttgtcacgacgcggcaatgaacaattcacgcagctgatgcaactggtcacgaatttgcgccgcttcttcgaactccagattctgcgcgtgttgcatcatcaacccttccagttcatggatcttctgctgcaacgctttaggcgacatatccatcggcacattatccggctcaacaatcggtcgcgattttcctctgcccttcgctttggttttagcaatgttctgccccagcgccaggatatcgaccactttcttgttcaagccctgcggcgtaataccgtgttcctcgttgtacttctgctgtttctcgcgacgacgttcggtttcgccaatcgctttcgccattgacggggtgatcttatcgccgtagagaatcgctttaccgttaacgttacgcgccgcacgaccaatagtctggattaacgaacgttcagaacgcaggaagccttctttgtcggcgtcgaggatcgccaccagcgaaacctccggcatatccagaccttcgcgcagtaagttgatccccaccagcacgtcgaactcgcccagacgcaagtcgcggataatctccatacgctcgacggtgtcgatatcggagtgaagataacgcacgcgctcgccgtgttcttcgagatattccgtgagatcttccgccattcgcttggtcagagttgtaaccagtacgcgttcgttaattgccgctcgctgacgaatctccgatagaagatcatcgacctgtgtcgccactggccgcacttcgataatcggatccagcaatccggttggacgcaccacctgatccaccacatcgccgcccgatttttccagctcgtaattacccggcgtcgccgaaacatagatggtttgcggcgctaatgcttcgaactcttcaaatttcagcggacggttatccagcgctgatggcaggcggaagccgtactccaccagcgtctctttacgcgcccggtcaccgcgatacatgccgccaatttgcggaatggtgacgtgtgattcatcgaccaccagcagcccatcggcaggcaggtaatcaaacagcgtcggcggtggctcacccggtccacgaccggagaggaagcgcgagtagttctcaatcccggaacagtagcccagctcgttcatcatctccagatcaaactgggtacgctgggtcagccgctgctcttccagcagtttgttattctccaacagcactttgcgtctggcggccagttcttctttgatctcttccatcgcctgtacgatgcgctcgcgcggcgtgacgtagtgcgttttcgggtagatggtaaaacgtggaatagtggaaacaatctgcccggtgagcgggtcaaataacgacaatcgttccacttcctcgtcaaacagctccacgcgaagtgcaatgtcatccgattctgctgggaagatatcaatcacctcaccacgaacgcggaaagtaccacgctggaatgcctgatcattacgagcgtattgcagctccgccagtcggcgcaggatcgcgcgctgatcgataatcatgccgaccgtgagatggagcatcatcttgagatataaatcaggatcgcccagaccataaatcgcggaaacagacgccaccacaaccacatcacgccgctccagcatcgctttggtggcggacaaacgcatctgttcaatatgttcgttaaccgaggcatctttctcaatgaaggtgtcggaactcggtacataggcttccggctgatagtagtcgtagtaggagacgaaatattccaccgcgttttccgggaagaactctttcatttcgccatacaactgggccgccagcgttttgttgggcgcaagtaccatggtagggcgctgaagatcagcaatgacattggcaatggtgaaggttttcccggagccagtcacgccaagtaacgtctggtgcgccaggccatcttccagcccctcttcgagacgtcgaatcgcctctggctgatcgccagaaggtttaaaagcggaattcagtttgaacggtttactcatgagtcgctacctgaaggagttgggcgggcaggtatgtaattttactcgtcgtacttaattatgccaacaaattatactggataaaaaaacagtttctcaccataatatttctgttacagcgtaaactccgctgtcaaacatgagcaaaatttactctgtggcgagataaaactccggccttaccgggttatccccaaagcaacggcttttttaacatttgtcaagatgagtgatgacagttttatggcaagagatgcctcttcagtgactgccattgcaattatctaaccagttaaaaaataaaagatatttctttgagccgtctttaacgccaattcgcgtgcaagccgcgtattctctcgcttgcctcgtgttttctaactctaatacacatggttatccacaggaatagtggataactgtctgcagcccctatcccccgccgcctgggcaattcccacatacatcgcatgatgcggaagtaaaatttttttcgtgattattttagaatttaattggttaaattgcagtcaatcgaagacgcgatctcgctcgcaatttaaccaaatacaggatggctacaacaaggcaaggtttatgtactttccggttgccgcattttctggattttctgcaagccaggggatctctcccagcagcggcgcgggaatcatgcgggtgagcgtggtcatatattcagcgtgacgttttcccggaggcgtgacatcattcgccacccaacccgccagagtcagcccggcgtgttgtattgcctgtgccgtcaacatcgcgtgattaatacagccgagtttcacaccaactaccagtatcaccggcagttgttcctgtgttacccaatccgcaaaagtgaaagtgtcagaaagcggcgtaaaccagccgccagcaccttccactaacacccagtcagcctgttgttcaagcccgcgtaatccggcgctcattaccaatgattctatcggcctgccctcttgtgcgctgatgatgtgcggcgaagtgggttctgcgaaggtgtaaggatttaccgttgcgtaatccagctgcaggctgctgttgtgctgtaacgccagcgcgtcactattacgtaagccttccggggtcttttcgctgccagaggcgaccggtttataacctgccgtccgataacctgctgccttcgcggcttgtaaaagtgcacaactggcgacagttttccccacttcggtatctgttccggtgacaaaataacgtttactcacgagcaattactcccaaaaaaagatgatacgtcagaggatatcgcccctgttgttgcggccaggccagttgtaatcgctgcaactgcgaacgcgttaatattcgcgggtcgcgcccttcatgaagatgcgtggcaccgatgcctttcagcgaacgcatggcactgagcgcatcatcaaaccacagcgtgatgggctgaatatgatgttgataatgcaggccgttcagcgactgttcgattttatctggcggtaaaaagcgattagcatgcgggcgctcgtccaccacctgccacgcctgatgtaattcagggagcgatccctgcaccagcgtggtaaacgcgaccacgcctccggggcgcaccaccctgtatagctcgcggagtgccgtggataaattaccgcaccactgcaccgcgagattgctccatgcaagatcgaaggttgcagtcgctaacggcagggattcgatatctcccgccagataatggtctgcggcatccttctggcgtgcctgaacaagcattggcggcgagagatctaacgccgtcacctgcgcgtgacgttcccgccagtggcggctcatccagccaggtccacaacccgcgtccagtacgtgggtgtatttacgctgtggaagcattgccagtaagacgtcagcactctggcgctgtagatccgcatgttgctcatagtgcgcggctgcccgaccaaatgccgctgcaatggcttgtttattaaccgttgccatgcagcacctccagcagacggtcgatatcctgcatttcatgcgcggcggttagtgttaagcgcagtcgcgcagtaccagcaggtacggttggtgggcgaatcgccgtgacccagcagccttgctggcgcagtttttctgccagttgtaacgcacggctgttatcaccgacgatcaatggctggatggcgctgcatgaatcagcaagcgtaaacggcaaatcctgtactccggcacgaaaacgcgtaatgagtgccgccagtttttcgcgccgtgcatcaccctcatcactgcgaatgaccgccagcgacgcacgtaatgcctgcgcctgagcgggcggcatactggtgctgtaaataagatggcgggcaaattgcagtagataatccgccaccgcatcggagcaaagcaccgctgccccgctgacgccaaatcctttgccaaaagtcaccaccagcaattctggatttaccttttgcaaccagcagctgccgcgcccctgctccccgataacgcccgtgccgtgggcatcatcgaccatcaaccagccattgtgctgttgcgttacctgctggatttccgccagtggcgcactatcgccgtccatgctgaacacgccttctgtcaccaccagttgctgccccggacagggggaagcaagcagtcgcgccagatgagcgacatcgttatgggtaaaacggcgaagctgcgccgggcttaaactggcagcttccagcaatgaggcgtgactcagccgatcggcaacaatacggtcctctttcgccgtcatcgcggtaataactgcctggttagcggcaaaaccagagataaacagcagtgcccgcgaatagcccagccactcggccagttcttcttccagcgcctgatgcgccacgctataaccgctgacgtgaccggaaccgccgctaccgacgccaaattgctccgctccctgcttccatgcacgaatgatgtccggatgatggcttaagccgaggtaatcattgcaggaaaagttcagatactggcgatcatccgccaccagccagcgtccggccccttgcgccaccggataacggcgacgcagggcatcggcagcacgccgcgcatcgagcgccgcgttgattttctcctgccagctcatagtgctgccgcgttgtaatattcgtcagtgtccggggtcatcagtgcctgctccagacgctgctgttgttcgttatcccctgccagcacggcagtttgctgtggatttagccccagtttgcggaacagttgcaggtctttatcttcttccggattcggcgtggttagcagtttgcaaccgtagaaaatcgagttagccccggccataaagcacatcgcctgagtctgttcgttcatctgctcgcgtccggcagaaaggcgcacgtaagaggtcggcatcatgatccgcgctacggcaatggtgcgaataaaatcaaaggcatcgacatcatcgttatctgccagtggagtacctttcaccttcacgagcatgttgattggcacgctttccggcggcgtcggcaggtttgccagttgcagtaataatccggcgcgatcttttaccgtttcgcctaaacccacaatgccacctgagcagactttgatcccggcatcgcgcactttttccagcgtatcgaggcgttcctgataagtgcgtgtggtgatgatattgccgtaaaactccggcgaggtgtcgaggttgtggttgtagtaatccagcccggcattcgcaaggcgctgcgcctgagattcactcaacgtacccagcgtcatacacgcctccagccccatcgcttttactccctgcaccatttgttccaggtagggcatatcgcgttcgtggggattcttccacgccgcgcccatgcagaagcgcgtcgatcctgccgctttcgctttgcgcgccgactccagcacctgttcaacttccatcaaccgctcggcttccagcccggttttgtagcgcgagctttgcgggcagtatttgcaatcttccggacaagctccggtcttaattgacagcaaagtgctgacctgcacctgacgtggatcgaaatgctgacgatgcacctgctgcgcttcaaacagcagatccagcaacggtttttcaaataattctgtgacttgcgacaatgtccagcgtgggcggtgagccatggggcttctccaaaacgtgttttttgttgttaattcggtgtagactcgtaaacctaaatcttttcaatttggtttacaagtcgattatgacaacggacgatcttgcctttgaccaacgccatatctggcacccatacacatccatgacctccccgctaccggtttatccggtggcgagcgccgaaggttgcgagctaattttgtctgacggcagacgcctggttgacggtatgtcgtcctggtgggcggcgatccacggttacaatcacccgcagcttaatgcggcgatgaagtcgcaaattgatgccatgtcgcatgtgatgtttggcggtatcacccatgcgccagccattgagctgtgccgcaaactggtggcaatgacgccgcaaccgctggaatgcgtttttctcgcggactccggttccgtagcggtggaagtggcgatgaaaatggcgttgcagtactggcaagccaaaggcgaagcgcgccagcgttttctgaccttccgcaatggttatcatggcgatacctttggcgcgatgtcggtgtgcgatccggataactcaatgcacagtctgtggaaaggctatctgccagaaaacttgtttgctcccgccccgcaaagccgcatggatggtgaatgggatgagcgcgatatggtgggctttgcccgcctgatggcggcgcatcgtcatgaaatcgcggcggtgatcattgaaccgattgtccagggcgcaggcgggatgcgcatctaccatccggaatggttaaaacgaatccgcaaaatgtgcgatcgcgaaggtatcttgctgattgccgacgagatcgccaccggatttggtcgtactggcaaactgtttgcctgtgaacatgcagatatcgcgccggacattttgtgcctcggtaaagccttaaccggcggtacaatgaccctttccgccacactcaccacgcgcgaggttgcggaaaccatcagtaacggcgaagccggttgctttatgcatgggccaacttttatgggcaatccgctagcctgcgcggcagcaaacgccagcctggcgattctcgaatctggcgactggcagcagcaggtggtggctattgaagtacaactgcgcgagcaactggcaccagcccgtgatgccaaaatggttgccgatgtgcgcgtgctaggggccattggcgtggtcgaaaccactcgtccggtgaatatggcagcgctgcaaaaattctttgtcgaacagggtgtctggatccggccttttggcaaactgatttacctgatgccgccctatattattctcccgcaacagttgcagcgtctgaccgcagcggttaatcgtgcggtgcaggatgaaacatttttttgccaataacgggaagtcagcgtgagggtttctggctacactttctgcaaactagaaaggagggttcatgaaactcatcagtaatgatctgcgcgatggcgataagttgccacatcgtcatgtctttaacggcatgggttacgatggcgataatgtttcaccgcatctggcgtgggatgatgttcctgcgggaacgaaaagttttgttgtcacctgctacgacccggatgcgccaaccggctccggctggtggcactgggtagttgttaatttacccgctgatacccgcgtattaccgcaagggtttggctctggtctggtagcaatgccagacggcgttttgcagacgcgtaccgactttggtaaaaccgggtacgatggtgcagcgccgccgaaaggcgaaacccatcgctacatttttaccgttcacgcgctggatgtagaacgtattgatgtcgatgaaggtgccagcggcgcgatggtcgggtttaacgtccatttccattctctggcaagcgcctcgattactgcgatgtttagttaatcactctgccagatggcgctatgccatctggtatcacttaaaggtattaaaaacaactttttgtctttttaccttcccgtttcgctcaagttagtataaaaaagctgaacgcgaaacagcaaaagccaataatatcaatgtgttaaaatacatttagtctaaaaaatagactgcatgatactacaaaaaacaacatatccagtcactatgaatcaactacttagatggtattagtgacctgagacagagcattagcgcaaggtgattttttgtcctcttgcgctaattttttgtcatcaaacatatcgcactccagagaagcacaacaccttgcagtccagtgcaaagctttgtgtaccagagttttcctcatcaactaccgcaagtatcgatcgattgagacttggatgatagacttcatacctttcagaactcattgattaaataaatgttaaatatatttgcaaggtacacctcgattggtgtgctgaacacacttatacactgggtggtttttggtgtatgtatctatgccgcgcataccaatcaggctctggcaaacttcgcaggtttcgttgtggctgtgagttttagcttcttcgcgaatgcaaaattcacattcaaagcatcaactacaacgatgcgctacatgttatatgtcgggttcatgggaacactgagtgctactgttggatgggctgctgatagatgcgcacttcccccgatgataactcttgtcaccttctccgccatcagcctggtgtgcggtttcgtctattcaaagttcattgtctttagggatgcgaaatgaaaatttctttagtcgttccggtctttaacgaagaggccacgatacctattttttataaaaccgtgcgcgaatttgaagggcttcagcagcatgaagtcgagatagtcttcataaacgatggcagcaaagacgctacagaatcaattatcaacgagcttgctgttgccgacccgcttgtggtttcgctgtcgttcacacgtaacttcggcaaagaacccgccctgttcgcaggtctggaccatgctaccggggaggcaattatcccgattgacgttgatctgcaagaccctatcgaagttattcctcacttgatagagaaatggcaggccggtgcagatatggttctggctaaacgctctgaccgctccactgacagcaggctgaagcgtaaatctgctgagtggttctataaacttcataacaaaatcagcaaccctcagatagaagagaatgttggcgacttccggctcatgtctcgcgaagtagtagaaaatattaagctcatgccagaacgaaacctgtttatgaagggtgtgctgagctgggttggtggtcgaaccgatgtcgtagaatatgcgcgagcagaacgcgttgcaggaagcacaaagttcaatggatggaagctatggaacttggcgctggaagggatcactagcttctcaacattcccgcttcgcatgtggacctatattgggttatttattgcatgtatatcatttacatacggttcatggatgataattgataaattaatttttggtaataatgtacctggatacccttcaattcttgtatcaatattgtttcttggcggcgtacaactaattggtattggtgtacttggagagtacataggacgtatttatattgaagttaagcagcgcccaagatatgttttaaaggatcagaaaaatgattgcaaataaaaacaaaacacctttccattggttcttgatatctgtttttatatatttcacccccatcatcatggcaaatattcattatgtagatgatcagggaagagctatatgggggtatactggatgggctagggatggtagacctttggctgaaatgttgatgattgcattgaatttcaacatgcacataacggacttattcccatttcctgcaatattatcagtatttttgatatctgtttgcctgtatttttttagcaggatgtttatatcgacagataataaatttattggactgttggttcctcttggtattttatcaagcccatttttaattgaaaatgcaatgtatcgctttgatgttttaccgatgttcataagtattgcattgtcattctcagttgtaatatttaatttcaaaaagacaattttaaatatttcttttgccgccctgttaacattatttatattgtctatataccaagcatcattaaatttcatgctggttattattctgtgtaaatatgtttacatgtactttaactcagatagtaacagacatctattaacttacctcatagaaaagacggtatcattagttataggtgttgcattatattttttggtggttattcctttatttttaactgttgttggggacccggatcacccatcaattaaaactgaaggcattttttcagttatatatgaaaacttaaaattttatcttcattcaatatctagtggtatttttggggaatcaggacgagttgcgtttatagtaatatttttatttttcattgcaatgacgacattcatcgcgctaaagaaatcaatacctaataaaagtattactggtattattaattttttaattacaataacatcaccagtaacagctttgatattgtcttttgctactctattaccacttcagcatcacatcgacgccccaagagtgatgatcggtttttctgctacgatgttgttcttattcatgattgtttatcttttctcgcgagaaacaaaaaattcaataacatatatacttgtaattcctctgatttatgtttttggttttttatgttcatacacaaatgcaatgacagaagaaaaaaacataaccacagttctgtttcatcagattaaaaatgatgctttcgagttaagcggaaaaacaaatcagatacttatttttaatggtaaaaagaaagacaatgatgtttttgtaaacgcacgaaataattacccgttaatatctagatttttcccagagtatttctataattgggattggccattcccttatatgaatagagttggagtttactttaaacaccctgggaatacaaacattgcaagtgtgttaaatgaaaaaaccttttgctcaaccgcaaagattaaaagagcatatgaatataacttatactcatatgatgatattattgtagttgattttgacaaaaacatttgtcagtgattattatggcgcatcgatactttatattgatgcgccataaattaatcaagtatttgttccatcagctcgctgccatgatgaagctgtgccgttataccatattggaagacctagcgttgtatcgtagtattcaactggcacaattggagagacaggcctctgcgcagttgtaccatataacaaagatgtcaacggagaggtgtaggccgcaaactgactgatgatgaaaaaaggcggctgaatgcggtactcgactacatcgacgcagtgacagcagttgatgctgcccctgcgcctgatatcaactggcccgctcccccggttgcgtaggccactctatttcgggtgccgctgaggtatcaacacggttcagcagtaccctgtattttttccacgccagcagtaacgtctgttcatcgtctgtcgccatttccaaatcaacggcatcctgcagcggtgctattgcgttatttgctacggtcagtagtgctgatttctgcagctcagcctccgcaactaacgcgttgtgagagcgttctgggggaggtggcgcggtaaatactccgtctgaatatgaccaaccgatgccagcatcgccgtttaacggaactaaattaccagcctctggtttccattcagaaattccgtcccagataatgacattaataacaacgttattatcaacaactgcataaacatcattcatttacatgtactcccgaattaccagcacgccattagctccgtgcccgccacgtcctgacgtgtgtgaatagctattatcgtatgcacccccgccgccggagccagagcaaactccagaattaccgctcagttgcccagcgcggccgccgccaccccaatagctcgatgccccattgcctactaatagcgcctggcccgcctgtccgtctgaaccgtctccgccttgttcagttttataaccgccagagcctgagccaccgcgcccgccagcggtatttgtagcgccgccccattgcccaccctggccgccgagcgcagttaatgtcatgaacgaactatgaccgccattatttccagaccctggcccattggcaccactaccaccgctaccaattgtcactgtataggtccctggcccggcatcgttgtctgtcgcataaatagtggcaaaaacagtacctccggctcctccgccagcccctgaaaatgtctgatttgcgttctccgcgttacatccaccgccaccgccgccccccgcagtcagaataacgtcaattcgttttacgtcagctggccacgtatatgaacccgacgatgaaaaaacgacagttttgctgtaacgccccgagccatctcccaaaccaaggttttcgagagccgttttcaccgtgccatccgatttgatatcaccaaacggattcttgcggcttaacagcagcgcacgaagcgcggtaagcaactggtcgtgccgctccttctccaggctggcaccggaggcctccaccacgctacaaagttcttcctgcaacatgtcaaagtagtcatcatccagatcggtggcaggtgtgccggtctgggggttaccacgggtaaaaccgttcttacccgcgccgaacttatccttctgcgcggttttcgtgtctatacgatgcatggattactccggatatttaaaaattacgtaggtatgcgacgggcagagtttgttaagcacacactcgacaacggtgtcgccccagatacgcagtgcggaatcacagggatcgccacatgtcatccaggtggtgttggtggcagctggcatgttgacctgccagtaataccgccattccggcgcattcaccgcgtcagtacaggccgatgagcaggtgaacgtgcttttgtcgtatcgcgtgatgttggcatctggtctgcccagggcagcaagctgtgcaagataaaaattctcgttgatgctgcccgccaggttaaccttcgcatccagccgttgctgacgctgacgaagggtctgtgtccctgcgggaatacattcatccggcagaccgcacagacgctcccagcggtttatcagttcagtggtggtgcgcggatccagctcccgcatcagggcatccgcacgctgatgaacacgggttaatgacggtgccgcaccggcaatcgccggatcgctggctgaccacgccggaccggggggcaacagtgccgacaacagacggatgtaatcatcgtttgtcacgtccatgaaatcgtccccagaaccgccagttcattttttgcaatggagatattgtctgccggtgcaagcaactgatggctgtattccccgttcgcaccggaaatcgcctcactgatacgcgataccttcagttctccctgcggataaccatcacgcagcaggaacgaacgcaactccgcggtgatggcagcccgtatttccggtgtgtccggcgtcacgcggatatgaaaatccaccgtatgtgccaccggcctgaacacatacaaatcagagcctgccaccggggccagtggcccgatatgttgtcttgccgccgtttccgttgattcttccggaatgggattaatcaggtcactgctggcaatcatcacaccgacagttcccgttcccatccagtgacggtatgtccatgcgcgggtaatgccgggcacttctttagcccagacgacatagtccccgtcagccccgccctgaggcgtccagtaataccgctcaatgacgcgggcgcgccacgtttccagctcttcagtatcaaatccacctgtcagggtatctgccacgccggaagacggcagaccattcaccggcgtgaccaggattaatgacgtaccgtcgtcagcgttaccgaccgcgcctgcacttgagcaggcgatcggcacgcgcaggacaccaccggagctggttgcatcggcagttgccgtgtactgaaccaggtcatcgcgctgaatcacgctcccggcagtcaccttcaggccatcgctgacaccttcccagcgcatatacccgctggcagccgtggcccccttgcgcggacaccgtttcatcgcagcatgtcgcgccagccaggactcatcgcacaggtcaggcagcatattcattgccagataatcgatgtacccgtaaaccgtatgcagcgccgccgcatacacctttgcccgcacgtcttcatccatgcgccggagcgtgtcgctgacgtccagcctggcgaataaatcgttacggagcatactgatattttctgccagcgtcgggcgctgaaattcactgtccgccatgcgttatcgcactccacagatcatcaaaagaaatcattaccggtccgtcacgacgccagagagtgatactgttacccagttcattaatcccggtgcggcggatatccagatcaatacgggacaccacgccgtcatcaatcatccattgcaggcattcgcggatatacccctttaccgtctgcaccagctgattggtcagtttgctgcgctgaagcagccacagccgggagccgtaacggtcattctgtaccgcaggccaggtatccccccaccatcccatcgggacgtcggcgttgtcatcaggctccgcccgccgccaggtaaacagggaaatcaccacggcgcgggtcagcggatccagcggtgcgctggcgcaggtgcgtttaccgttcaccgtcagccacagttccatcatgcctccatcgctttatcaggtttgtcggtgttactgccctgaccgttctctctgtgacgatgcccgttataggcaagccgcatcgctgacatggtggtgccgccggagtcgcacaggtctttcacctgtccggtcacttccagatccatttcaaaacgtgcttcaggtgcattgcgaaacgtgatcgttttccctgcaccgtccaccacgatcccctcccgggtcagcgtcacagactgcccctgatcgtcatagacagccacctcacccgtttgcagccctttcaggcggtagcgccggtccgacaccgtaacaaccaccgcatgagaacggtcgccatccggaaacaacaccaccgcttccgcaccgctgtttgcccttgcggtaaaaccgtagggttcaagatgttcaaccccggctttgggttcaccggcaatcagggacacatccacggtctgacatttcgtggcggcactgatgcttttcaccactgcccgcccaatcaggccgagaagttgtcgctgcatggcttcaatcgtcctcatcagaacgggtcctcctgtactctggcttttttctttttccgcgcgccgggggcttcgggttcaggcagataagcatcaggcgggccgacacggatttccgtcagggtgccgttctggtcctgagtaaacgtgacttccgagacaagcagttcggtattgtcgaaaccacagaccggatcgaagacaatcacccgctggttgggctgccacagcgtaccgttaccctgtcgccagccctgcaccacataggtggtttcatccgtccgcgccgcccgttttcgggcttcaaaatcagcacgcgcaatacagcctgcccccgtggcctgccctgtctgcctgatatacatcggacggtaacgggcaataaatgcgtcctctgtgcgggcccgcagcgcggtggtggtggcctcaccgaaatcatcgtcgtttccggcacgctgccccgccacctggtaaacagaaaaccgctcccggatactcttctccgtatcacaggaaaggatgttttccccaagtaccagcgcggtatgtgcccgcgttgagccaataccgccaatcaccagcctgccgtgcgggtcgtcgtaagccagcgcctgctgctgaccgagtattttgttgattacctcaatcaccgtttcaccgtgatcaggctgaacatcaggaataacacccgacggcgcaccgctgttcaccacctcaatgccgaaaggcgcagcaagcgcctgcgcgatctgcaccagcgagcgtccgttaaactgtgtcggttcggctgcacagtcaatcaggtcagccgtcagactacgtccggcaataccggtgctgaccgaacgggcatcgtaacgaacgggagtcgcctccacccagccggtgatcaccagctcatcaccaatcagcacttccacttttgaaccgtttttaatgcgcggctgaagcgtggtgataccctcatctcccggccattggagagtgatctccacactgaaatcccgcgccagccgttcaataccggcaccgatgcgcaccgatgtccagccattccactcccggccatttacccgtagcgtgacattgtcgttcattgcactggcaccttcagagggatcaccggcacaaagccgggatgcgtaatggcattacgccggataatgtccgcgtcacgcgccgcgttatcaaaccaggtcgccgccagcaccagcgcgggtaaaacctcatccggcgtgcgctgaatgatccgtgcagactgttcaaggcgcgtgttgatatccgcattcagatctgctttcacccggcgcagcgccagaaacagcgcatcactggttgtacgggacaactccttatcaattgccgtattcagtgtgtcgcgaatgtcggtcagttcttcccacgttggcaggtcaaccgtgtttttcaccgccggtgcattgttcagtgccggatgcgtgacagaaggccagccggtgctctgcgcgggtgttgttgactgccctactgtggcattctgcatcaccgcggaagttgtgggcgcaggcaatcgtgtgacggcatacgccgcttcgctgattgcggtcgtacgaagggtgctggcaaccacgttacgctgctgcgtcgccgtggcggtagttttactgtccgttttccagacgccgcgcggttgcagatcgctgccgaggctgacaccggaaagcgttttgatcatggtgaccaggtcgctggcgttaccataaaggcgtttcccggtacgccacattttctgcacctgctcaacgaaatttttgcctgacgatggtggcggcagaagtaacgagatatccccctgcaacagcctggcggcatccgatacggcagaatccaccactttcatcgcatcagaaacatacccaagcattgtgctggcattaccgacgacgtcgttctgcacaaaatctgccacgccatcgatactgaaaccactgaagctgtcactgatgcagtcatccagtgcagaacaggatgacatcagcgtctgcgccgtcgccgcacctgaagtggggtaagagagttctcccgcttcgacaaacttcaggtcaaagcggacaatacgcccttcactcttcgatgtgctgacccgaacttccccgtcaacacagactttcagctcaccgtaagtcggatggacaagcgtgccgggaccgggtttattcagcgcgtcaatcaggcgatcgcgctggtcaaagcagtcatcgcccaccacataagctgtgatggacgggcggaaagtgattttccccaggtcttcggtatagggtttgtcgcggttcgggtattcgtgcgtttccacacgacgaccggttcccgcactttcttcttcaaccttaaacggcacaccgcgaaatgacgcgtcctgaagtctgtctttccacgtcatataaactccgtacataaaaaatcccaccggagtgggactcattaacagattaatttttcattacctgccaaagcgcgtatagccaacatcatggctgacatcaaaaccgctggatcgcgtttccataacccgcatacccggaggcgaattcacaaaagagaccttgatctcaccatcaacttttggcgcagaagctttgttaatcatgaagggattcgggcctgtggcaccggaggcgttgtttgactgagccggatctaccgcctgataaggtgtgtatccccgtgccggtattcccgtcccataagcatcataagcacccgcgccccactgcgcagagttaatggcatcgaccgtgtcaccggaactgtcggtaaaccactcaataattggcttcagtttgtcccacatatcctgaaaccacttaacaaccggtccccagttattgattaccatccccagcggcgaccaggcaaaaaccttcttcagaagttcccagccagcctcaaaataaggaccaatggtttcccagagcttcttgaaataaggtccgacaacatcccagttagtgataattaatcccgcagccagggctatcgccgtcgcaatcattccaatcggcgtcatcgacatgatcctgctgacaatactgatggcaccgccaacgcccatcaatcccagtttcagaatcgcaagaccggcagcaagcccgacgacgccgcgaataacccggggattttcatccgcaaacttcgtgaatttttcccctaactcccccagccattgcgtgatatttttggcgtcaccagaaaatgcgccgccaatagccgcaaggccgttagttgcggtccccgtcattgcctcccacaggttggacagcgtaccaagctgggcctgaacacgtttattcaggctggcctgtttattcatcttctgctggatctgatcgtagccatcctttcctttatcgattagtgcattgaccacctgaagggtttcggcatcatcaccaaatattgccttaagtacacctgttcgcttaacgtcggtcagttttcgcagctttgccagttgcctgaacatgttatcaagaccgccaaaacttcctttgccgtcagtaaaatcgagctgtaccccgagtttctggcgggccatgattttattgacgtccctgattttcttaacgcttaatccggactgaataacttttcgcagggcgttacctgccgactccccgttcatccccatctgatccatcatgacgctgatgggggcaaggctctgtgcagcctgaagaccgtccttgttcaccatcttcagaacagagctggttttagcgaagaaggacaacatgttggtatcgtcaacacccagataaaacgccttctggatagtgtcgaacagccccatcatgtcttctgacgccgttccggtagcatcctgcatctttgcagcaaactcagcagccgcttccggtgtttttttcagttgtaccgcaagataagctgtcgctttacccacaccgccaagaatgttttctgccgggatcccctgacgcaccagcatctgcatcatgttctggaaatcagccgttgtaccgggtagctggttacccaggccaatagccagtttattgatgtcctgaaagctctttccaacctcgccgttcgcatccatcatggcgactttcagcccggtggcggcgttttcctgatcggcataagatttcagggaaagcgtcagacccgctgccagtccgccaccaagcgccagcccaccctgtgacgcttcttccgcctggcgtttaaatccccggattttcttttgcattttcgacagcgcgggagaaagcctgtcgacaccggtgatcaacgccttaagctcaaattccgccatgtgtgcgtttctcctgctctatcctgtttgcctgactgaccagcaagggaatttcactgatcggcatattcagcaattcgaaaggattaatgcgccagtagctggcgcagtcaaagaagcgatcagtgaggtattcagccgtcaggcctggaggaaaaaaccggccacaagccacgccgctgcattcaggtctgccggagacatctggtcgacagagctttgcggcactttcgccagccgcacaatgtatttcgacaccacatgcgccagaagtctgactgactcatcctgattcatctggtagggataccccagctcgcggacatccttcccggtgggttcatcaaactccagtacggagagtgtctcgccatgagcagtaatcggtttctttaactcaagctctttcattactggtaatccccttcttcaccgtggaactcaagatcaaccgtgccttcttcggcattatggttcgcttcgccgtgcagccaggcagacgacagtacatagacctgaccgttcgccagctcggcagtgatggtcatctcatcagacgaggtgattttgcttaccggaaaattcttcggcaccttgaaggtccctttgacataaggcgcacggtgagtttccttgcggtccactgaaccgtccaggccgatgatgtcatcgttaaccgttttgttcatgggcacctcaatgccgccggtcagcgatagctgctgaccgtcaattttgaaataacaggttcccccgatacgggccattatgcagactcctctgaatactgaagacggaactgattaaccacggcaaagacacgcagctggttaacatagtcaggcgggaacagcgtgttcaggcggttcggatcgctggcatcacgctccacaaccaggtactgcttaaacagttcgtagttttccacgatccccgcacgctcaagctgacggtaggttgccagcagttcccctttgatcaccgccggggtgacaatcgcctgaccgggaccaaagcgggtaccgtcactggcaagcttgtgacgcccgtacttactggtaatgacggatttcagtttgcgcagtacatacgcgctggtatgcagcgtctcactgtcgaggtaactgttatccgcaaccccgtaagcgtttttcctgtacgtggtgacatcacgctgaatgcgtagtaccccgctttcgacatacgccgttgccacgccatgagacagcagggtctgttgttcggtcatcgtgaaccgtttccccttcggcgcaggcagcatacccaccagctcaccggtctgcgtgggacgtgccggatcgttgcggataaacaccgctgcgcgggcggtacggcttgccgccagctcgtcggcaggcgtctgggtctctttttcgtaccccgccagggtaatgtgctgctggttaaactggtcacctgcggtcaccagttctgacagcgtgccgatctttgccgtatacacatgaccatacagctgacgcgcatagctccagcgaccgctggtatcgttcatctcggtcaccagcgtgttaacggaggccgtgtcgttgaacggcaggccgatataatcaaacggctcatccgccattgcagccaccgcgccggtgagaacaggagcgcccgttccggcgctccccgtcgccacagcaatctgtacgcccgctggcagcacttcgcccccaccaaagccgtagtaattgaggctgacaggaatttcattcccgcaaagccccttatgacgcgcggtcagcgtgaccacgcctgccgaagatgaggccgtaaacggcagggccggaacggcattaatggcatctttgatactgctggcaatcgtcgcgacgttatcgccgttggtcaccggtgcctgcacgcgggtacgtcccacataaacattcaccgtgccggtttcggttgccgccccggtcaccgtcagcgtaaccgttgccgccgcgcctgtggcttccggaacggcaatcacatacagctcgccaaacgggtcggtctggcgataagcctcgaccatacgcgccagctgacttcccgcaccacaaatctggcgtgcatagtctgccgacggcatcagtaccagactgttggcaacaatctctgcaccgttattggcatgaccaatcagcagcgatgctccgctgtcctgtgcagtattcgccgcctggttatccatttccgcataaaacaacggaaccagcgtattcgacggaatggtgttaaagcttatcgtcatcggtgttcacctttttattcacgcgccggatatcacccgctgcttcacggcgcagccagtagttgttctcgtcaacatttcgcccttcggcgggcaaaaggtcgccgcgggcagggtcaggcactgaccgccctttaacaggtttgacaaacatgaggatcctcaggaaggaagggttatttcggtgtgatgttcgatatcgccgtcaggcccgttaccgggctcgagataatcaacatcaatcgccagcgtttgcagttcatccagactgttcagatcatcctgctggcgggtatcgtcttcagtcagctcgctgatgaccgaaaaatcgaactgataaatcagctcatgacgattcagatccagcagcgtgccgccgtcataggtaatcgggttaccgcacgcctccgggttccagcccagcagagccttaaagagcatctgccggacatcgtccaccacatcatacgaggcaaactgaccgcgctcatcacgcccgttactcagtatgacaaccacggagaaaccctctttcagctcctgccagtagtcggtctggcttttgttttctcccggagaatcatcacccggtacaacatatgccgccgggagtttcagctttccgacctccggcagatttttgaactgggccgcgcctgccacccggttttcaaaatacggacaacgggcacgcagtgcagcaataacaggcgtcagtttcatctgtgtcgtcgctccggcttcagtgatttacgcaattcccgcgccagaaaatagcgtgtccagctgcggttcttttcaagcgtttccaccatgaagttattacgtggagccagtcgccagccgctgccaccggatgcaccacgatgatgactacgacgacgttttgctcctccccggacaccaaaaaacagaaacgccggatagaagtcaccagagatcatccggttccccttcccgttgcgctggttaggggcaatgcgtgtcataaaaccagctcgctttttactggctctcggcaccatataaccaatcgaacgagccaggcgtccggtctgataaccggggttttcacccggtgccgaccgcgcacggcgcatcaccagccgacgggcatcacgcatatgacgctgcccaatcgtgacaaacgcccgccggacacgggcgcggttaaagcgcatctcggcgggctgctgaacatcaacgtgaaaaaagggagtcgccattgctgcctccgtgactctgcctacattcgcccagctccgtacactccagcagcagaaagcgccgcgccccgttcagatcacgctgacgtttcacccggtacacactgtcatcacagaccacctcataatcagcagtgatcccccggcggtaacgaatggtgatgtaatgggtgatggcgtccccggtctgcgcggtttcctgccaggtggtggcactggtctggataaccttcgcccatgtccggaacgtaaccgggtattgaggctccacgccaaagttatccgcgggcatatccacccgctggcggatcaggacgcgtttattcagttcaccggggtccggcagaatgtaggttgcgctggtctgcgcctgacgaattttcattgcggaaagtacctgtacgggccgacaagccagccaaaactctgcggcatgtcgagtttctccacttccgtaaccgacgagcggttttcgtaaaaatggctgataagcatcagcatccccagacgaatatcatccggcaggtgcagcccgtccggatcgctgtccggaatggtttcatccggtgcatagagcttccggttcagatacgtttccgtccgcttttgtgccgcacaggccagcagttgcagatggcggtcatcagcatcgaaatcctcatccagccggagttgggctttaatctcttccattgtcagaagcatactcagccctctttactggtcgtggcttttttctcttttgtcgatttactgctttttgcactggttccgcgctctgctaacccggcctgaagtgcaatctcctgcacccgggcaggaagcgccccttcgtcatactcaccggcccgaatgacctcaacacgcataccgtccggtgaccatttcagatcttgtttcaggatcatgattcttcacccgtcagaacaggggcgcggttccgcgcccctgagtgattacgccactgcaatcttcagcagtttgatggcctgcgaatcgaccagcatgccgccggtgcgtttggtggtataaaaaccgacaaacggtttattggtgtacgggtcacgcagaatgcgggtgccgatacggtcaacgatggtgtaaccccgtttgaagttaccaaatgcaatggctttcgcatcagcggcgatatcgggcatctgttcgttttcagcgataccgtaacccgccagagaggacggctgccccagctccagccccggacgccacagatagttaccctcgctgtctttcagcagacggatggcaaacaggctattgttgttcatcatgaacttcgcgccggtgcggtgtgccttacgcagcgtgtaaatcagtttgataatggcgtctgcggtcaccgccgtcgcgtcgccggatacaatatgctgaagtttgccgaacgcccggaccttatcggtttcatccgtggattcatacgccaggaaccctttcggcttcttggtaccatcgccggtggtaaaggcaatttcttcctgttcggcaaattcggttgccagctcgctgttgatccatgcttccacgttgaaaaaggcatcatccagcattttctgggtggcctgcgggttaccgtagatttcccccatgaaaggttcaatcaggcccagttttgaggtggcagtctgggagcgcgcgtcagtctcgccaacccatccggaagccgtgccgcccagattcaccagttttttgtagtcggaaccaccaacggtgatcaccgtggcttcctggcgcatcaccacttcatctttcagcagggtgagaatgttgcgatccagtgcttccggcacggcatagccgccgtcttcatcggtgcccacctgtaatgccttgcgctccagatcccgcagaccatcttcacggcctttacgcaggaagcccacaaacgcttctttatgctcggtggccagtttattttgcgcaccacctgccggacgtttcagctcaagcagctctttttcaagatcgcttttgaggttttccagctcgctgagtttcccgttcagggtttccacctgcccggcaagcttgcctttttcctgctcaatcgcatccacgcgcttgtcgttctttgctttgaagtcgtcaaacttctgctgcagctcctgcgcgacctgttcgacatctttaatatctaccgccatcgtatttctcctgattagaagttcagatttttcagtgcattcagtgcagagctcacatcctcagcgtcgcgcagggacagtgcgccatagcccccggccatgaatgctttggcctgggtacgggagagtccgacatcacgcaggactctttcgatttttttctgttcggggatttccccgcgggccagcgcgttcttgacgtcgctgatccgcgcctcgtcgttagacgggaacgtcaccagactgacttcccagaggtcgatttctttcagcagaaaggcttctttcgtccggtcgtattcccagtctttcaggacgtacccaatagaaaggccggttaacgaaccggccttcatgtgtgcatgtgcgcgttttgcgaggggatcatcatcaataagcaaccgtcccctgacgtaaagcccgacatcgtcttccttcatttcggtgtaaacaccgatgggttcatccatgcggtgctgccagagcagcgcaggtaacgcttttctgtcactccacgcccgcagggaagcggcaaatgcccctgacatcaccacatcatcgtggctgtcctttacaccaaagacggagccatacccttcaaactcaccggagtcactgacagatttcagactcagcggtacatcaagacgttgtttcgtctgcattggtgttatccttctgcttaccggctttactgccatcggagggtttcgtggtcatgttcatcggtgtgagatagacatcaccaccgggacgcggattcatatcttccaggtcgcggcagtcattgggagagtaaattccccaattgatcccggtagcgtaggcttcaaaacgggacttcatatccccgcgcagtaaggccccggcgttaaatttggcgtaataaacgccctgcttactttttcgtaccagtccggtgttgatccgctgctcaatgcgggtcagatacggcaccagtgaatagttgataaatcccagccccagctcttcgatattgttgaaggtggcgcgatcggtgttctgcaccatgtgcaatggcacccggaacagacgacagatttcttcaagctgaaacttgcgggtttccaggaactggctgtcctcggcgttcagcgccatcgacttccagtccagccccatctcaaggatcatcgggcggtgagcattgccaagcccggtgtgacgctcctcaaaatctttcttcaggcgctcataagcctgatctgacagcgtctgctctgtacgcaacacacccgacgtcaccgcgccattgctgaacagtctggccccgtgctcttcggtcgctgccgccagcgatattgcctcgcgggcataggcgatgggattcagccccaccagtccgtccagcgtcagcgtgcgcacatgccagatatcttcctggctcagtacatccgtggagccatccgggaatgtgaactgatagaccggctcccagctactgttaagcttcggtaccacacagccgggatcgacgggcagcagttcagccacttcgccaaatgctttcactttgtaggcgtaaaagtttccccgcaggcacagacaggtgaccaccagctcccagaactcctgcggcgtcatatagccattgggatgcgtggagatcagcttatgcagacgttcgccagtggctctctgcttcaggctgccgttcaggtgatacaggttgcagggcaacatcccgaccgactccgccagcaccctgacacaggaaaaaaccgccgtcagtcgcatggcccgctggctgctgatctgctttccggtataggtgtcgtaggacaacccgatagcatccgccagctctgctggcgtggtcaccggtgcgtcactttttcgttgaaataatcccgaaaagaacactatttacctccgccgacagacgactgtgtacggtcgagatatcgcgccaccagccacgaccagaacaggcacaacgccccggcaacaacaaaccccgccgggggataaatcagccaggcaccatacgccagcaaaagcacccccagcacgcccaccagaggcgcgagaatcagcatgatcataattacctcagttaaagcgagcggatcccgtaggactcaatgtggtcggacagcgtgtcttctttctcatacagcatggctctgccaaccgccataatcagcgcaactgcaccatcgattttgttttccgcctgctctttgacgggcttcaccacatcatcgttacccggaatggttttgccgaccacgttgccgatacaccaggtcatgatgggattgccatcatgatgaaagcgccccgattcaattgccgcttccagctctttcatcgggtcggacatgttggtgtagttctgaatgatggtgatgggattcaggtcttcatcagcaaggtcatgtgacagcccggtcgccccgaaggggtcgatgggtgactcgctgaccgggctgattttgttcgccgctttggcctcttcgaggatgtagcgataatccacctctgcaccatcggtaacggtcaggacgcccatttccacccatttctgaaagcgttcggctgtccgtcgatcttcatttttctcgacgctgtacaccgtgtcatacggtacccagaaacgcggggctacactgtagtaatgcgttttaccgtcaatctcgcgggtataaagtcgcgccatgctgttcatatccagtttacgcgccaggtcaaaggccagaatgcacggctgcccctcgaactgctcaagggacagtgatttatcctcgcagctctgccagctcaccaggttgaaatacgccgaacgcgccgacacccagatattgaggtgttttgttttaaagacgtttgccagacgggcgttatttttcgcacgctgctgctgacttaacaaaaattcgcgataaaccgacacgccaatattcgggttagctttttccagcacctgcgggtcggtccagtcatcgccttcgtcaacggtatagatgatcccgaacagttcatcgttgggtaccgacccgttgagcatctcgataacttcccgtcgcttgtcgtagcacggcccctcaatgttgtacccggcagtagtaatggcccacatcagtggctgacgtcgcgcccccatcccggtaagcatcgtggtgtaaagcgcatcggtggcgtgctcgtgatattcatccaccaccgcacagtggggtgatgaaccatcaccggggttaccgatcagcggttcaaaccgcgcgccatcctccggacgattcatgtttgaggcgttaacctcaatcccgaacgcttccgtcagcatgggtgtgcgtttacacatcagtcgcgccgggcgaaagacttcccacgcctgtttctctgtcgtggcaccggaatacacttccgcgccaaactcgttatcacaggcaaaacaatacagggcaacaccggcagagattgccgatttgccgttcttacgggggatttcggtatacacctcccggaagcggcgcagccgggaccctttattgacccagccaaacgcacagcagaccacaaatagctgccacggctccagcgtgatgggcatcctcttgaatgcccactcacccttggtgtgcggcaacagctgaataaatttggcggcccgttcagccaggtccttgtcgaagcggtaacgaaacgacttacttttttccgccatcaggtcatcaagatggcgctggcaggcctgaatcacaaactggcaggccacaatctttccgcgcacaacatcacgggcatactgattggcagcatttacgttggggtaagatttccggctcatgactcgatgattttcagaaacgggttagtggctttcttctgccccgccaggccaatcagacgctggcggctgctggggtcgagtccgagcattgcccccgtactgctcatctcggactcctgttcttttttggcggtcagctccggatttttgaccataccgcccattgcaccggtgatggtgttgccctgtctggcaatatttttcacggcacgtcgccagaactcgtaggccacgcaccaccgctcaagcaccgcgaggtcagtcacgcacagcaggccctgaccgcagagttctttagttgtcagttgccacatgatcgtggcgagagggagatcttcttcagcgaaccactccggtggctcaacacctttgatgggcgtaaaaacaggttcatctttattcagggctcgcttgccggggtttccggccagcgccttgcgcgccgttggcttggggcgacgcccggaacgccccgccgttccagccatatgcggcactcctggttaaatttcatttttcgcgggtataaaaaaacgatggggcgggcagtccggaagacgtcaggccgcagggatttgacccgcccctcccctcaggcagttgagaattattatcacttcaaccgttcacgggccgtcttcgccttatgacacggccagcacaaactctgcagattactgtcgacatcagtgccgccatgcgatttagggatgatgtggtcaacggtcttcgcctcacgcaccacaccagcacgcagacataactgacacaggcctttgtcacgcttcaggacacgcgcgcgaatactgtcccacttcgaaccgtagccgcgctgatgacgggattgtccaggtttgtattgcttccagccttcgcttttgtggctttcgcagtagcctgaagggtctgtggttgtagagcggcagccgcgaacacggcaggcttttggggttcgtgagggcattgcataatactcttggttggttcacgtgcgatatgtggcatccttttcagaatcgaagcgtattccactacggttttgccataaaaacctcaggatttttttgttagacaaatcgatagtaaacgttcaaatttacaagatattagcaacaaaatagcctctacaaggaatcaatatgtttgattttactcattttgaagagttgactttagcatcccatcaacccgatagaataatgactatagttcggtcccaagatgacattggtatctatctccgcactcaccttttgattgaacaaatcttggaagcttggattatctgtgcctctggtaacagggatttcttcagcggttttggcgaaaatatcaacatggattttgccattaaagctcagcttgcgatgaactatgggatgagctcagagctaaacaaatttattcgaaggttcaacaacttcagaaacaaacgttcacatcaaattaacaactctgacatcactaacagtgagattgactccttaacaagtctaatggagcacggttaccctgatagcttgacccccattagagattttaagcttggggtttacggagcagaaactagggttgtaagtttcacgggatcctctacaagcttacgcgataagctcattatgttattcgctatgttttccatgagggtacattacgaagcaaaatgcttaagcacgccacagagctaggctctactttgatgctctaataacattcgattatttgcatttcctgttgcattagcgacctgccattgaggagtaaaaatgatccatacggtacattttttgacagatgttacagttgcctctgtaactaatctgatggatgtctgcttaaaagcagtttcaaatactaatcaaccagcaacagaaattaagctctatatttccagcaaaggtggagatacagtttcaggctttactgcttacaattttttaaagtcacttggtgtaaaggttactacgcataacctcagtaatgttgaatcaatcgcaaacgtgatctatatggctggagaagtgcgaactgccaacccactttctcgcttccttcttcacccactgcattgggggttcgccgcacccagcgcagatcacctacgattgagagaatgggcttcatgcctcgatgacgatctaaatcgatttattcaaatcatggatattgaaacaaaaaagaaaaatccaagtgagattgctgattggaaggatttgatcacttcggcaaccatccttcatcccggaagggcctccgagttgggaattgttcatcaagtcgaggctgcaaccatacccacggaatcgatccgctggtgggtactttaaaatcataatattcaccataatgcgggcttagaagcccgctctttttttctcagcctgcctgatatcagccttatcccgattgcactggccaagtgccgatagcagactgacatttaaattaagactattaccccatgtcatattatccggaatgtcaggataaggcgtttcagccgtcagggtggctggtaacggaaccaccggaatgctcacgtaaactgttcgcgtacttccgcaaccgctcagcagcggcagcaggcacaaggcctgcagcacaatcatcatccgcaacagccactttgatatctttctgggttctctgtgactccagtgcgatctgctgttttgcatgctggttaacctctataactgtattgacgagttgcagtgattgcaggacgttacgggtaatggctgttgcagattcagcattttgtacagcctcatcagcacgtttcttttcgtgctgatatttgctgtagtagtggttggctgaccagatgaaagaaccaatgacagtaacgaagaaagcagcgataaccagcttatagctcaacttcatttaccaccccaccagcctctttaaaccgggcaatcaggtcaccgattttatgttcatactgaccgtaaccagcacccggcagtgaagcccagatattgctgcaacggtcgattgcctgacggatatcaccgcgatcaatcatcggtaaagcgccacgctctttaatctgctgcagagctacagcgtcctggctttctggagaaaaatctttcaggccaagctgtttacggtaagcatcccaccagcgtgaaagaagctggtaacgtccggcggctgttgatttgagtttggggtttagcgtgacaagtttgcgagggtgatcggagtaatcagtgaacagttcaccaccaacaataacatcataaccgtggttacgtgtcggttgtcgcccgttatccgttccttctgaccatgccaccatatcgaggaaagctttacgctgggaatttagtacctgcataaattactccttagagccaccaaacttattaccgattactctcattgcagccccacgaatagcatcgacaccgatcaacccaacgccaccaccaatggcaacagaaagcgatttaggccatccgacatactcaagcgcggatgcaaaagtcagagtcagagcgccacagagcaaaatctcgagcgtttttcgcttccagccgccaccaccaccaaagtaggcgatacgcaaaccagccataacaatcgacataatcactgcgcccagcggtgtgtctccacgccaccagctctggaacaactccagccaggtatttgggttatgaggcatttgtagttatctctcacctcgctgatacagcaggtgcaaattgagggaacatcatgtaccgcaaatcagaagcggaaacgtcaaagaagccgaaccaatggataactgcggaatagaccaggaccaacgaatccccagccccagaaacgacaaaacccgctcgacggcgggtttaagctgtgtggcgaagtaaccactcttaacagattacaatgttttttgcgtacgcgttagcattttcgtaaaatacattaccttgcaaccatttcagtataaaaaatgagcacagaattaaaactaaagaaaattatggcatcgtctaaaattgagccatttattagacatattcgttttcctttttttaaaaaccttgcagagggtagcaagattgattttgagtatccaattacagcattagttggtcaaaacggaaccaataaaagttctgttttaagagccctattcggttctccaaacaactattctctgggtagcttatggttttctacagatgtagatgagattaaagatggtggtcgttctagatttatttatggatattatgacaaagctactgattcaattgttgaagtaattaaaactcgaatctctaaagaaaatgatcctgattactgggaaccatccagaccattaaaatccgacaacatggctccaatgcctagtacaaaaatctcaaccaatcaactaaggactaggtggaaagctattgacaaaaatgtaatatatttagatttcagagcaactatcagtgcatttgataagttcttttatcactctgattttcatacataccctaagaaagattatcttagaaaacgcagtcagatgctaaaagacattatagataacgatcttaaaaaatatcaacctcataaaggaaaaaaagacaagctatttgttaacactttattagaaaaaagtaaggtagaggcaatcagcaagattttaggtcgcaaatacacaagcatccgccttattgaacatagcttattcactaatgacaaagctcccacaattattcttcaatcagaaaacttaaaatattctgaagctttcgcaggcagtggggaatttgctgtatctatattagtgcataaactaatggatagccctgatgcatctttaattctgctagatgaacctgaagtatcacttcacccttctgctcaatgtcaattgatggaatttttatcagaacaagcacttaaaaagaaacatcaaattgtcatatccacacattcatcaacaatagtaaaagacttgcctaaaaatgccataaaattattctgtctgaatgataaaataggaaaggttgatgttcttcaaaatgtcagcccagaagaatctttctttattcttggtgaacgcattgataaaagaaccgttattgtagaagatcggttagcgaagaggtttgtagaaaaggcgcttaaagcgggtggtgaagcattattaaactccttcgaagtaaaacatgttcctggaggagcgggaagtattcttcaaactttggctgtgcctttatgtgttgccaatgttaaaaacgttattttcttattagatggtgaccaatcgagaactgatgattatccaacttctgattccataccagaaaatcaaaacacaaaccttcaaaacatcataaaagaaataaccaatcaagatataaaatttagttgtgatggttctaatggctcatcaaataacaatcaaaaatacaaaatgcaaagaaattttatcgatttcatccacgataaaattgcttttcttcctgtttatactcctgaagcatttcttattgagaatgttcatggtgattataaagaatataaagatcaaatccccaaaaacattcaagatgctaaagaaatcaccaaagaactttgtaagttagacacagggttggaaaacgttaccagtgacgatatctttgaaacacaaatcagaattcttaataaaataccaaataatcatgaagtgttaacaaaaactcgagagttgctgcaaatctttttagataatgatactatcagaccaagagtgaggtagataatggctaaaaagatacacgtttacgatttcttttccggctgcggcggaaccagtgtaggcctaaaagcggtgggaatggaaattattttcggtttagatattgatctagactccgctaacacctttaaaatgaataatccatttgcacattttatcaatggtgatatcaaagatacacacgttgaggaaattaagcatctggtttgtgcgtcaacacaaagcaaagctctaaccctattttgtggttgtgctccatgtcaaccattctcgaaacaaaataaaatacggaacgaggatgatccgagaaaagatctgcttactgagtttgcacggtttgtctcttattatacgccagactttgtactggtagagaatgtaccaggaatccaaaatgtcgatattaacaatggaaatttccagaaatttcttgaggttttagcacatcatcactacaacgttgattttggtgtgattcctgcgttgtggttcggggttcctcaaacacgtgaacgttttgttttactggcgtcaaaacacacgaatattaagcttccatcacaaactcatgatggattaaaaactccgtatgcaactgtcagagactggatcggcggattacctcctattgctgccggtgaaactcataaagatgttatggatcatacagcagccaaactatctgatctaaatattaaacgtattaaagcgactcctgaaggaaaaggtagagaatcttggcctgaagaacttatactaaaatgccataaaaaatataaagggcatactgatgtttatggacggctttcttgggacaaaccagcaagtggattaacaactagatgtataagctattcgaatggacgtttcggacatccagagcaagatagggctatttctgttagagaggctgcgttattacagactttcccattagactattccttcacaggctctttagtctcgaaagccaaacagatagggaatgcagtccctcccaagatggctgaagctcttggaagggctatcatcgcatcactttaaaagcggagccctagagggcttcgcctaacaataatagaatacctgatataaaccctatagctccctgaagctcttttctaattgctccatcagagcattttcttttcttagcaatggtgcgtaatgagataccaatcacaaaatgagcaatgatcagctcatattcttctggtttatacttccgcaggcgggcgacacagccatcaatcatgatgccttcatcatcatcgcactgaatccgggactttctgccatgaggtaaaagccccttgaagccagcggctaccggttgccaatccacaccactgttctctgccgcagcccacgctccccaacggtctaatacttcatacatatcacacatcaactttctccaccaaatcaggctagcacaccaattgccaacgcacggtcgataaaacgaaatatcagctccagctgggagccatacttctcttcaaatgccacggtatccgcatgcagctcgtcgtgatgctttctgcacaaaggcaacacaaagaggtcatgcgcttttgtacccattccaccctgaccgtggcctatcaggtggtggggatcatcagcaggctttccacaacatgcacacggctgtgtcttaacccagcgcgtgtacttttcattaacccagcggcgacattttgggcgtaacataaaagactccggcgactctggatccactttcagcgccagcacctttttcgctttatcctggataatgctggtggcaggaaccgaaggaacaaggtcactctcccgggtgacagacggcacaacaggcttaggtaatctcagtgccttacgggctgcactttccggtaaggcatcagccaggtcattacgaaccagccaccagcacagttccggcattgttacaacgtgactatcatcaaaaccgagatcacggcgcacaacagataacacccagcgggcacagttatccgttgccattgattccagccgttccgtgaactgatcgcgcagctggttatcgcagtgccagcacagacggattgcgcccggcgcgtgtcgcattgtggtcatgttctcgctgtgccagtcggaatgaggccattggcagcctttttcacgaagtaaccagctttcaagacattccactccaccagcacgacggatcactgcctcattgcggaacacggcccgaacggcaggatcatccgccagcggttgtgatgccgccggaacggcaccactggcaaaagatgaataacgttccggctcaggctccagcaggacacgcccctgcataaacaggggcatcagctctgaacctggcctgaacaatacgatccccatacgcggggcaatttcaggagtcagtagtgctctcacggtcacctcaatgaacggtatcgagcagctttaacagctcagggaatcgggattcgaagaaatgcggctgcgtctcgcgcggatttgcgggactggtgatgttcttgccgaacatgcagcctttcgctgtcagcgaccagaattttttgatgttgttaatcgcggtacggctgtatcgttcgcgctgctcgacgatccccagcttcaccatctggtgatatgcctgattagccgtcaggcggataccatactgtttcagcagtgcactcagcgacagcgtggggcgacttgagccatcaggcgcgtcagcaggagcatcaatggcatagcgcggtgccagattcggtaagccaacagcctcctggagtttctgacaggcaccaagcactgatgagttagacaggtttaattcccggcgcataaagtccagcagaatcacgccagcctgcatcttgtcagcagcctgtccggataatttttccggtgcgctggttaccatatcgaaagtacggatcaccttcagatggaatgacgggctgatccacattgcataggcatacaccagttctttgcagacatacgtcccctggttatttccgccacgactaacgttaactggctctatattgaccgagttgcaaatctgcaactcgcttattaaacgttcggtttgctcattgcggagccaaaatgcaggcttatgcttatcctgagaaccggcagccctgtgcagatcgttcaggctgtaacgcccataagcatcacgacgaacttcaataccatcaatgaccatcagattattcatacttcgtttctcctcttgatcaggcggctgcacccgccgttttctcgtacttactgatagtgatctcgaccttccctttcgggataaccggtccccactcaaccagcattcttttcacctggctgtcgtcttcccacacacccgcgtgggtcagggcgtcaaacagcgccttgttatagttgtccagatcgcggatccggttatccggaggaaacaacacgatctccactgaagcaggtgccgacgttggtttcggcagacgacgtaactgctcaactattgctgtgcacgccgcactctggaattttcgccccgccgcgcttatcaggctcttaccagcaaatgcccctttgttggggtgtcgccagtaggtgttcacgctgggtggaaaaggcagaatcagcttcatactttcagccccctctcatgtaaccagtgggctgcacgcggcctggcgttttcctcaccagcaagcagtgcgcggataatcccggccgcctcgctatcgtcgtccttcaccgcggtatgaagcgtgatgccccgggccacgccacgctttatcgtgatgacgccttttttctccagtgcgcgaagatgctccaccgctgcattcactgaacggtatcccagcatggtagccacctcctgattggttggcgggaagccacgttctttctggtaagaaatcagcatatccagcacctgctgctggcattgagttaacgtcgtcattaagcccccacgtaattccctgacagataccactcttcacccgatgcagcgcgcttgctgcttttccgtaagcaccgctcacgacgcgccagaaaattgtttcgttctggctgggagtggctttcacggaatgcctccatccacaccgttgcagctcgacggaataagcccctggactccagttcttcagcctggcgggtcaggcacaaaatcacccgggggtcgttagtgccgacatagaaattgcgcacaggtctggtttcacaaactggttccggctcctgcgatatctcagcctggcgcgggaaatgtctgcgtgtatcctcttcacaacggtgagccacacgcccactctgacgtaacttgcttgctgactgcagaactcgctgccgtgagtaacctgcaaaagcatccgcaatgtctccggaagtacaccccggatgggcttcaatgaatttctgaacgtcattcaaaaggctcatgatcaccccctgaatcctgccgggatctggctgtagtccacattgtcgtaactggctttgaagtacgggtcttcgcgtttttctgtgtacgtgctgacggacggcgataagcgcagggaaagttcatcccatttttcccgcagcttcgacgggctgagcacgttacggcaccagaacgggtcgcggctgacacggttgtacatctcgcagatttgtttgtgggtacgaccgtcctgtacacacatcaggcgaatttcatttgcccaggctgtccagttcggttctttcggacgtaccacctcgccgtcacattcggcggcctgctcgtacagggcgatgatttttttccagagccactgtgcgcaggtcaaatcatcctgcgttccccactggcgctttttagggctgaatacaaccgcatcaggatggcgagttaaaaaattctgttcagccgtctgcgtgtccggttgcgaagcgtccggacgagaaggttttttatctgacggatcatgttttgattttactgacggatccccgccagattctgacgggtgaaaacccgcttttttgccagatttcgacgcatcaaattttgacgggtcagattttgatgcgtcagattttgacgggtcagaatctgacagttgagaaaatgccgctgcctgaagcttcgcaacgttaagctgataaacattcgacgcattgcggttaccctggcgacgcgccttacgcgttaaccagccttctgcttccagtcgtgcgatagccgttctgacggtactcatccccgcgccaatctggcgggcaatggtttcaattgatggccagcacacaccttcgtcattactgaaatcagccaggcgggccataattgccacgctggataacttcatgcctgacgcagcgcaaccatcccatacatagccggttaatttagtgctcatgaccgacctctatttccctgaatttacgacgaaactgttcgagcggactgaagcattcatgctcatagccttcgcggaggtagataacccgttgtgtttccggttcccaacgaatgactctgacgggcactccgtagtgatctttgaaccagcggttaacttgtcgcaaaggactgtctccttctgccggttgaaatcacccacagcccactcagcaaagctgtgggttacaatttccctgtcacctggtacattcactgcatagcaatattccaccttcgcttttccacccggtacaggaagcgcaatcagttgcgagcgacggtagtgtgttgttaaactgttcatgcgttagtttctccacagacacaaaacgccacggcgcccggagctgcacactcgcgggcgtcactcttttctggagcgcaaaagattttgtagaccagtgctgcatgctcctgcagcttcgaaattgacatgtacagctcgtcgttaattgctgcctgctcgtgtggttccaccaccccgtcttcaattgctgaacgaatctgttttgaataactgccgatctgttcaataacctccaacaggcgctggttgatatcggcgttctctacttcctcaatttcaggaagtgatacaaacaccccaccagcagactgtgcgacagcatccgcaatgtggtgattgccagcagcacgctgtaaaaccattgcccatcccaacgggaaaatctgatcgccatctgcacgaaggcggttgaataaagcgttctctgttacatccagccagtcagcagcttcagcgtaaccccctggcaatgccgcgatagtttttctgacagctttcacgtaccactcaggttgtttttccactttccaatgatgcttacccacggcttacctcctgttcctgtggtttaaacccattctggttttggctagattgaaaacgtgccggataaagaatctgcatttcgctgacttcacccttaaaaaaattggctaaacgttctgcaagttcgatagatggaatctgctccagcctctcaatacgactcaacgtcgctggattgacttgaacacccgcagcaacatgctgcaaagtgaaaccatgcgccttacgcacatttcgtaatggtgattgcatataccctccaaatattgcgcgttatgcatgttatttcacgcaattattttgcgcaagttgatttgcttatcacgcaataaagaaatgtaataaacgcatgaacataggaaaccgagtcagacaacttcgccaagcgaagaacatgaaaatcgccgatctcgctgaagcaataggagtagatgcggcgaacatctcgcgcttagaaacgggtaagcaaaaacaatttaccgaacaaacactgagtaatattgccaagagcttaggtgttgatattgctgatctctttacctctgccctcaaaagtaatactgtatataaaaacagtaataatgaggatgttgcgcaggtgaaggatgtgttccgtattgaaatgctggatatcagtgccagtgcgggaaatggccttatccagggcggtgatgtcattgatgtgattcatgccatcgaatacagaactgataatgctgtatcaatgttcggcggacgaccagccaatcacatcaaagttatcaacgttcgtggggacagtatgtgtccaaccattgagccaggagatctcatcttcgttgatgtcagcatcaatcagtttgatggtgatggtatatatgtctttggttttgatgacaaaatatacgttaaaagacttcaaatgattcctgacaaactgctggtgatttctgataaccagatttaccgtgaatggggaattactagcgaaaacgaacaccgatttatggtctttggaaaggtcttaatcagtcagtcgcaaacccttaagagacataattaacctcaatatcccatccatcggccaccgaaaggtggctttttattacccaccgttttgcatatttcgcaaatattacttgcatatctcgcaatttaattttatcttttgttccagaccaactacaggattacaacaaaatctggttgcaacacggtgcacggtgcatgtgtcgtaagaggtcagtaaatgtcaaaaacgaacaggcaggacgcccacgaagtagccgccggtggcgtatgaatgaccggatgattcgttagcaacaaaaaaagcgccctataggacgcttcgctctttaacaatctggtccccatcaacaagtaactgataacttgaggaggtgtgaaatgcacaaaacagaaccaaaaatcgtcgcgcctggctacacagatgaggaaatttatgagtggatgacaaagaagctggcagctataaaccagcttcgtgaagtgctgtcttatcgacaggaaacaatagactccttaaaaaaactggatcaggaaatcacggttttatcacaggatgttactttagatattgtgcagacaaattaggatcccattcattttcgtcaaaatcatcaaagtgatgaatttgtgatctccagtctcgataatctaaaaatttctgggcggttacacttattttatcaagcgtgagttcatcctgaattgaaagaagaagttcatcaaatttcatctcattaatctgttttggcatccagtgatgcttcatcagaataaggtgaaccagagcctttttcccattcaactgattatagggtgtgccgaatttcttccggtgctcatttaagacaaggtccagaagagtaagtaatgttgcccttgattcaactttgcttatttcgactgatgacactaccccactgatttcaatgccccgatactttccaacattttcacagtgggatttgtacagcgtatagatattaccggacatttcttttccttttgcgttgttggggataaccagattaaccgaatccttgttgttggggaataaccaggtccacctcgcctgatgtggctaaaagcaggcacataacagctaagtattttcaaccagagagaatccttagcgttgtggtgaatgcggctcagcgcacgcgggttaaggttgaggctgacagtcgaccttctgtggatacccacccgcctggtgtgcaaccttcgccaggcaccgggaggcacccggcaccacaactttatgctgtgtgtagtcctggcggtaccagtttgtacccttgcttccggctggtaccgtcctttttacaaaacagagaagagcatcaccggacgacgggctcataacccaatccatccgggcggcagtcaccgcaggtgttcttctctgttttgtggagaaactaaccgaccttgcagggtcgatatgatgaggagcagcaaaatggctagcgaacgcagtactgatgtgcaggcatttatcggggagctggacggcggcgtatttgaaaccaaaatcggcgcagttctcagtgaagtcgcttccggtgtgatgaacacgaaaaccaaaggtaaggtctcactcaacctggaaatcgaaccatttgatgaaaaccgtgtgaaaatcaaacacaaactctcatatgttcgcccgactaaccgcgggaaaatttccgaagaagacaccaccgaaacgccgatgtatgtcaatcgcggtggtcgcctgactattctgcaggaagaccagggacaattactgactcttgccggtgagcctgacggaaaattacgcgcagcaggtcattaatatcgttcttaattaactgattatttatctcatcactgaatatctttatatagtgaggacttattatgtctcagaacttagacgcaaccgcaattaatcaaatccatacccttatttctgctcagggtgttaatgaaattatcagtaagattggtgccgatgctgtggcattgcctgagaatttccgcattcatgatctggaaaaatttaatttaaatcgcttccgtttccgtggtgcgctttccactgccagcatcgatgactttacccgttattctaaagatcttgcagatgaaggcacccgctgctttatcgatgctgataatatgcgtgccgtcagtgtacttaacctgggtactattgatgaaccaggtcacgcagataacaccgccactctcaaactgaaaaagacagcaccgttctctgccctgttgtctgttaacggtgagcgtaactcccagaagtcactggcagaatggctcgaagactgggccgactaccttgtgggctttgatgctaatggtgatgctattcaggcaacaaaagcggctgcggcagtccgtaaaatcacgattgaagcaaaccagaccgctgattttgaagacaatgacttcagcggcaaacgctccctgatggagtctgtcgaagcgaagaccaaagatattatgcctgtggcatttgaatttaaatgcgttccgtttgaaggcctgaaagaacgtccgtttaaattacgcctcagcattatcactggcgatcgtcctgtactggttctgcgcattattcagctggaagcagtgcaggaagaaatggctaacgaatttcgtgatctgcttgttgagaaattcaaggacagcaaagtagaaacctttattggtactttcaccgcctgatttcattactgcaaatgcccctgcgggggcatttatggaaacgtaattgactcaataatcgccggatggtgagggcttccttttaccagaattcagcgcggtgcagcgcatatacgtggagaacaaaatgtcatttattaaaactttttccgggaagcatttttattatgacaggataaataaagacgacatcgttattaacgatatcgcggtttctctttcaaatatctgtcgctttgcaggacatctttcacatttctacagcgttgcccaacatgcggtgctttgcagccaactggtaccgcaggaatttgcttttgaagcgttaatgcatgatgcaacagaagcgtattgccaggacatcccggcgccactgaaacgccttcttcctgactataaacggatggaagaaaaaatagatgcagtaatccgtgagaaatacgagttgcccccggttatgagcacgcctgtgaaatatgccgatctaatcatgctggcaaccgaacgccgtgatctcgggcttgatgatggctctttatggcctgtactggaaggtatcccggcaacagagatgttcaaagttattccactggcaccgggccatgcctacgggatgtttatggaacgcttcaacgagttatcggaattacgcaaatgtgcataactcatgtagttagtttttctggcgggagaacatccgcatatcttgttcacctgatggaagaacaaagaaaggctggcaataacgtctgctacatctttatggataccggttgcgaacatccgctgacataccgctttatccgggaggttgtgaagttctgggacataccactaactgtgttacaggtcgatataaatcctgagcttgggcagccaaatggttatacagaatgggagccaaaggatattcagacacgaatgccggtgcttaaaccgtttatggacatggttaaaaagtacggcacgccatacatcggcggcgcgttctgtactgacaggctaaaactcatccctttcacgaaatactgcgataaccatttcgggcgaggtaattacatcacatggctgggtattcgtgcagacgaaccccgtaggctgaaaccgaaatcgggcgtccggtatcttgccgagctgtcagattttgataagtcggatgttatccggtggtggcgaaaacaaccttttgatttgcaaatcccggagcatctcgggaactgtgttttctgcatcaaaaagtcaacgcaaaagctggggcttgcatgtaaagacgaaccaggtctgatgcgagtttttaatgagctggttacaggcaaacacgtcagggatggtcatcgcagaacaggtaaagacattatgtaccgtggtcacctgacgcttgacggaattgccagaatgtctgccaacagcgactacagaaatttgtatcaggcgatggtacaggccaggcgattcgataccggctcgtgttcagagtcatgtgaaatctggggtgatcaattggaattggaattcgaagaggtaggggtatgacaaccgaaattaactaccatgcactgcttgagcgcgcacggaataaagtgcagagcattgagttcgccttaacacagagtgcattcgctgagattcgcgctgagcttgaaaatgatttagaactggcacggattgcactggcatctctggaagttgagccagatgaacgcgcagcctatgaattatttatggaaaagcgtttcggtaaaacagtcgatcgtcggagagcaaaaaacggcgataacgaatacatggcatgggatatgactctcggttggatcatctggcagcaacgagctggtatccatttttcaacaatgtcacaacaagaggtgaaataatagagccatacagcctcacactcgatgaggcctgttcattgctcaatgatatccagacctaccatcgccgcatcaatgcggctttttcttgcgtgtaattgcggagactttgcgatgtacttgacacttcaggagtggaacgctcgccagcgacgcccaagaagccttgaaacagttcgtcgatgggtgcgcgaatgcaggatattccctcctccggttaaggatggaagagagtatctgttccacgaatcagcggtaaaggttgacttaaatcgaccagtaacaggtagccttttgaagaggatcagaaatgggaagaaggcgaagtcatgagcgccgggatttaccccctaacctttatataagaaacaatggatattactgctacagggacccaagaacgggtaaagagttcggattaggcagagacaggaggatagcaattactgaagcaatacaggcaaacattgggttattttcaggacacaaacacaagcctctgacagcgagaatcaacagtgataattctgttacgttacattcatggcttgatcgctacgaaaaaatcctcgccagcagaggaatcaagcagaagacacttataaattacatgagcaaaattaaagcaataaggagggggctacctgatgttccacttgaagacatcaccacaaaagaaattgcagcaatgctcaatggatacatagacgagggcaaggcggcgtcagccaagttaatcagatcaacactgagcgatgcattccgagaggcaatagctgaaggccatataacaacaaacccggtcgctgccactcgcgcagcaaaatcagaggtaaggagatcaagacttacggctgacgaatacctgaaaatttatcaagcagcagaatcatcaccatgttggcttagacttgcaatggaactggctgttgttaccgggcagcgagttggtgatttatgcgaaatgaagtggtctgatatcgtagatggatatctttatgtcgagcaaagcaaaacaggcgtaaaaattgccatcccaacagcattgcatgttgatgctctcggaatatcaatgaaggaaacacttgataaatgcaaagagattcttggcggagaaaccataattgcatctactcgtcgcgaaccgctttcatccggcacagtatcaaggtattttatgcgcgcacgaaaagcatcaggtctttccttcgaaggggatccgcctacctttcacgagttgcgcagtttgtctgcaagactctatgagaagcagataagcgataagtttgctcaacatcttctcgggcataagtcggacaccatggcatcacagtatcgtgatgacagaggcagggagtgggacaaaattgaaatcaaataatgattttattttgactgatagtgacctgttcgttgcaacaaattgataagcaatgcttttttataatgccaacttagtataaaaaagcaggcttcaacggattcatttttctatttcatagcccggagcaacctgtgaacacattttcagtttcccgtctggcgctggcattggcttttggcgtgacgctgaccgcctgtagctcaacaccgcccgatcaacgtccttctgatcaaaccgcgcctggtacctcttctcgcccgattctgtcggcaaaagaagcgcagaatttcgatgctcaacactattttgcatccctgacaccaggtgcggcagcgtggaatccttccccgattaccctgcctgcgcaacctgactttgttgtcggcccggcgggtactcaaggtgtaacgcataccacgattcaggcggcggtagatgcggcaattatcaagcgcaccaacaagcgccagtatattgccgtgatgcctggtgagtatcagggaacggtgtatgtccctgccgctccgggtggaattactctgtacggtacaggtgaaaaaccgattgatgtgaagattgggctttcccttgatgggggcatgagccctgccgactggcgtcacgacgtcaacccgcgcggcaaatatatgccaggtaaaccagcgtggtatatgtacgatagctgccagagcaaacgcagcgacagtatcggtgttctctgctctgcggtcttctggtcacaaaacaatggcctgcaactgcaaaatctgaccatcgaaaacacgctgggcgatagcgtagatgcgggtaaccatccggcggtggcactgcgtactgatggtgacaaagtgcagatcaataacgtcaacattctcggtcgtcagaataccttctttgtcaccaacagtggtgtgcaaaaccgtctggaaaccaaccgtcagccgcgtactctggtgaccaacagttacattgaaggggatgtggatatcgtttctggtcgcggcgcagtggtgttcgataacaccgaattccgcgtggtgaactcacgtactcagcaagaagcgtatgtgtttgcaccggctacgctgtctaacatctattacggtttcctcgccgtaaacagccgtttcaatgcttccggtgatggcgtggcgcaactgggtcgctcgctggatgttgatgccaataccaacggtcaggtggtgatccgtgatagcgccatcaacgaaggttttaacacagccaaaccctgggctgatgcggtgatctctaatcgtccgtttgcgggtaacaccggcagcgttgatgataacgacgaaatacaacgcaatctgaatgacactaactacaaccgcatgtgggaatacaataaccgcggcgtgggtagcaaagtggttgcagaggcgaagaagtaagagctattaactatttgccggatgcggcgtaaacgccttatccggcctacggttcgatgcgatttgtaggtcggataagatgcgccagcatcgcatccgacaataagtgccgaatgcgacctacattcacatggcgctttttacatctgacggtttttattgaagttaatcaaactacccgccttgataatctcgcgctcttcggccgtcaggctttccatgtaaagcgtaatttccgttaccggcgcatcttcatggatcacataacctttaaacgtcgtacccggattatccagcgctgctttaatgccagggatgtaaatgtaatcccccacttcaaacgttggtgcttccgccatctgcagcggtaacatcccccagttgatgacgttagaacggtagcgtttagtcgcgtactcctcggcaatattcgccagaccgccaatcacacgctggcagctcgccgcctgctcacgcgcagaaccatcgcctggtttcaccgcatagaccatgctgccaatttcagtttgcagcggatcaatatgctcctgaccagcaatctgcttaatgcgcgcaaacacctctgtcagctcgctgacattccccgccagacgctgattttccagctcagcagtcgctttacttctgccaacataacctggatcgcggcgtgacagggtaaactccgccagaccaatcggatttgaacgataagaagaggtttcaccggaagggatcagttcgtcggtggtggtcacttcgtcgaggatcttcgagcacactttgaggacgatattgtcagttagcgcccccaattctggccagtcttttatgttcggtccgtaaatcaacggttgctgggtcgcccctttcacaaagccctgataaacacggtttttatacggcgttacatcgaaggcgtactccggtacgttgtcccagcaatcaagttcgctggcagaggttaaatagccaccgtttgccgcagtcgcagcgatagaacgagcgtccatcaacgccaccgctgacatctgcccattggctggcttagagccttcgcggttcgggaagttacgcgtggtgtggcgaatactcaaaccgttgttgattggcgtatcgcccgcgccaaagcatgggccgcagaacgcggttctgatgattgcgcctgcgccaatcaaatctgctaccacaccttttttggcgagatccataaacaccggctgtgatgacgggtaaaccgctaacgagaaggtgtcattgccacaggattgaccgcgcagtgcattcgccgccgcgatgacgttttcgtagttaccgccagaacagcccgcgataatcccctgctgcactttcaggcgaccgttttcgactttatccagcagcgagagtttggctttaccgtgcgccacgcgctcggactcaatttcaatctcacgcagaatatcggtcaggttctggttcagcgtgtcgatttcatacacgttgctcgggtgaaacggcagcgcaatcattggtttgatggcgcttaaatcaacgctgatgcagccatcgtagtacgccatcggttgagggttaagctggcagtaatcctggccgcgaccgtgcagcgccagccagttatggacttcttcatcggtttgccagacagaacttaaacaggtcgtttccgtggtcataacgtcaacgctgttacggaaatcggtagagagcgcagcaacaccgggacctacgaattccatcactttgtttttgacgtagccgtttttgaacacggcaccgatgatagccagcgccacatcctgtggccccacatacggcgctggttttccggtcagatgcaccgcaacaactcccggatagtcgatatcccaggtgtcattaagcaattgttttaccaactcgccgccgccctcaccgactgccattgtccctaatgcaccgtaacgggtgtggctgtctgacccgaggatcattttgccgccgcctgccatcatctcacgcatatattgatggatgaccgcaatatgcggaggcacaaaaataccgccataacgctgagccgccgataaaccaaaaacatggtcatcaccgttaatggtgccaccgacggcgcaaagtgagttatggcagttggtcagcacatacggcagcgggaaacgttccataccggacgctttagcggtctgtacaataccaacaaaggtaatatcgtgagaggctaatgaatcaaacttaattttaagtttatccatatttccggacgtattatgagaagagagaatagaccaggcaatagtgcctttttttgcttcttcttttttaatttcgccggtgaaatgttcttcggcaattatttcgttattactggcgagaaacacgcctttttcagataacttgatcatcaaatgctccagatatctgcgcaccgagaagtgcgcagaaagataataaatggatatactctaaataattcgagttgcaggaaggcgacaagcgagtgaatccccaggagcttacataagtaagtgactggggtgagcgaacgcagacgcagcacatgcaacttgaagtatgacgagtatatttacagcatgttccagccgatcagcatattccaccaccacacgccgagggtgatatgcaccaggaaggttaatatcgtcagtaccgcaccgaccaaccaccaggatttaatatcgttataacccacgccaaagatgaccggacctgccgcgccgccatagtgagtaaccatgccgccataggagttggagaacaacagtgccagcgcggttaacattaacggtgcgccggagacgttcgccagcatggcaaataccggtaacatagcaacgatataggcactaccggaagcgaagaaataacgaacgatgatgctgaggaaaataataacgaagaaagcaacgttaccgtgaccatcaaatgccaggttatttttaaagacttcagctaaccattcgaagaatttaactttcgataataaggagcttaagccgataataccgccgtaccagattaaggtattccagccgcctttatttttaaccacgtcttcccaggtaacgatacccagcagcagcatggtcgccataacaacgattgccacggtggattcatcaacccccagggacttactgaaaatccagcccagcagcgccagcacaaagacaccgagcagcattttttcgcggattttcatcggtcccagttcggcaaggcccgctttggcgatggttttattatccaccttcttaatttctggcggatacatggtgtaaatcaccagcggggtgaccagcagcataatgatgcccggcaatccggcggccagcgcccatccaccccagctaatttgcaggtgcagaatgtcgttgatcattttcagcgccagaatgttccccgccattgcggtaaagaacatatagctggtggttttggtgaccatgtaaatggacatcatcaggtaatgtccaacacgacgcggacttttttccggttctgaccccaaagccaccgccacgctgttgatgatcggtaacacaatgccgcccgcacgcgcggtgttagacggtgttgccggagccagtaccagatcgaggaataccgtaacgtaacccagacccagcgtggtgttaccgattttaccaatcagcagataggcaatacgtttacctaagccggtggtcacaaatgcggcgcttaaggtaaacgccgagaacaccagccaggtggtacctgaagagtaaccgcttaatacggcggtggtcttaaacgcaccgtcggataagttaccgaccaccaccattgaggcagcaacggcaattaacagtacgacaggttccgggaaaggcttgataaccagccccacaatggccgccaggtaaataccaaaaagcacccacgccagttcgcttaatcctgccggagctggcataaagccaataatacatgggatcgctaatatcagaattagcttccataacgattttttattcatttaaaatcctgttctttctgtatgactcatacagaagtcctttattgattgtccttatcctgacaacgaattttttcagggaagaaaaacttcaccggaaaatatttttctggttgtccgaataacagatgcgcgtaacgtcgtggcatcctgaccttcattacttaaatgaacgtcgagcgcaccactggggtgttcaatattgatattgccgtatcctacagaagggacgatttgtcgggtgacggtgccttccaatgcacaactactggaaatggcaatagcaccggttatcgccagcgcgcgatggcaagaatgcggcataaaataacgcacattaattgctccgcctttctgcgctggagaaataagcacaggtttagggataaccatattactgacatcgcctaagcccattgctttacccgcttgtagacggatagattcaatgcgggctaataatgctttgtcggcatccagctccgccggtaattcatagcctgtttttcccagatattcagcaggaataatgacaactggcatcgccatatcgatacaggtcaccgggacatcgtcaaaataatcaatctgattatccgtcgggaagacttttccggttttggttccggcggcattcaggaaagtgagcgcaaccggtgcggcagtacccggtacgccgtcaattctggcgctaccctcgtactcgacaacaccatttggcgtttgcacatcagcttcgatgaacgtacccgtattgacgttgcggatacgtacgcgggtaactggcgaagtcgctgcaatcaaaccattttcaatggcgaatgccccaacgccagacagcatattgccgcagttaggcgtggtatcgacacgttgctcatggacgataacttgagcaaacagataatcgacatcagcacgcggatcgctggaacggctaataatggcgactttactggtcagcggattaccgccgccaataccgtcaatttccagatcgttaccggaacccataattgccatcaatattttatcgcgctgcgtttgatcttcgggtaaatgttccgctaacaggaacgcgcccctcgaggttccacctcgcatcatcacgcagggtatttttttcataataatgccctcaatttaaaaacataacttattgcgatatggttacattaagggcaaagcatctctaatgactttagctcaacgattaataacattttttcattaatttaagttggctaaatgcagttaaaatttttaacggccagccacccaaaatcgacgcttccattttccggagtaataatgaagcatgaattatcaagtatgaaggcatttgtcatactggcagagtccagttcatttaacaatgccgctaaattactcaatattacgcaacctgcattaacgcgaagaataaaaaagatggaggaagatttacatatccaactatttgagcgtacaactcgcaaggttacgttaacaaaagcaggaaaaaggttgctcccggaggcgcgggaattaataaagaaattcgatgaaacgctttttaatattcgtgatatgaatgcttatcatcgtggtatggtgacattaggtaatgactccaacttactgatagtgttttatgttcagataatgcccgatgaccttgtcatgcagctccaccgattttgagaacgacagtgacttccgtcccagccttgccagatgttgtctcagattcaggttatgccgctcaattcgctgagtgtaacgcttgctgattacgtgcagctttcccttcaggcgggattcatacagcggccagcccatggctccagatgacaaacatgatctcatatcagggacttgttcgcaccttccttaacttcgctctccacttaactttttagttaaggagagcgaaataatatcaaagtagcagtaaaacctataacgtaaattcaaattgttaaattaactccctccagtacacaatacttcacacgttagttatgagcgatttctgatagtgcctggtttaatcagggctttattatctgcgacgtttatttttatttaagagagatcgcgatgatatcattaaaagctccgcacaataatttgatgccatatacgcaacaaagcatacttaatacagtaaaaaacaatcagttaccagaggatatcaaaagctccctggtctcctgtgtcgatatattcaaggttttgattaaacaatattatgattatccttatgattgtcgtgatgatttagtcgatgacgacaaactcattcatctcatggctgctgtacgagactgtgagtggtcagacgataacgcactcactataaatgtgcagtttaatgatttccctggattttatgactggatggattaccctgatcacccggttaagtttgtttttcgcatacttgaaaatcaaaaagggacagtttgggtatatgaccaggatgatgcgtttcttgatattaaagcaaatgtgcaggctggacgctttaccgggcttaagaaattagtgcagtttatcgattcagtgcgaacagattgcaaatgtattcttcttgaacaccatatgcctttgctgagacttttccctaaagggaaagagtgtatgcatgtggaaaaatggcttcgcgaaatgtcgtctattccggagaccgacgcacccattaagcaggcgcttgcgcatggattattattacacttaaaaaatatctaccctgtttttcctgaatcactggtgatgttattgctctctgttctggacgtaaaaacatacagagatgatgcgcgattaaatcaatggatatctaatagagtgcaggaattaggtgacagatattatcctgtaaataagcacgttaaaatccgctacactctttagttcagaaagggttccacctgcgagttgttattccaccagagagtgaatcgcaaagcaggtgatcatttcatctgtatatccgtatgccaaatggcattccaccgcctttttcgccgatattttgttgtgatcggcgacacttcgcttaaaaaagcatcagcagtggtttcgcagctatacggtgtataaaaaatgatctcatgcagatgttttgtgaatgtgtgggttgacattcatatgaaaaaaatcataattccatcatgtttgtgtggggtcttttctgtatcttacgcatcgcactcaagcctgacagaaaatatgctgtaaggctcatatcaaaaaccgccattagctcatcaggaagagcagacgacaaccaggattgttgtatggtacggggttcgaggcctcgatggcggtccaacttttcataactcttctgaatcagatccccttattatcatccctgcaaagtggaacattgccattgtttggctattcaggacgggtcagagcaatgaaaaaagcccacacaggggagagtgggctgaaatgggaagctaaagactcaagtaaacttatcggaaataaggaccacgcattacgggggctatcatcgccgatggtcgggattcggcaaatcaggttgattacgtagagagtaaattatctgctcaccgctgtgtcaccccttcgtaaatcaggcgtagcgcgaatacaccaataattgcaccaataacccgactggcaacgcgttgcatacgcccataagcacgacgcacagcgggcaaagaaaacgcctgactaagaaaaacgcgccagataattgatgcgagcacaatccccgctcaggccattaaacgtgcccatgttggtgtttcggcatttaatgttactgagaaaatactgataaaaaataaaacggtttgcgggttagagagatcggtaattaatccacggcgaaaaaagacataccagggggcgttaatcggttgttgtagtgtgctcatttgcggtgttgactggcggcgcatgctgcaccacgcaaaccataagagataagcgccgccgacgattctgataagcgaaaaaatctcctcacactgcgtaattagcgttgcaagaccaaacaaacccaacccggaataaaatgcatcgcccagcgccacgcccagcccggtcagcacccctgcgcgtcgaccggaagccaggctggtttgtactaccacaaagagattggctcccggattaaaaaaagtaatcacgaacagtcctacggtcaggtaaacggcgtgcaaaggatccatagtgatttcatccataaataagtgaactaactgcatcatatttctaccaaaaataatcgggtgcgagagagatcacaaagtgtcttatttccggttactggcgtttatgccctgactgaactaattattaatcaacccaataatgtgggtgggtgatagtgtgataacaactctggagccgtaatatgaaaataatctctaaaatgttagtcggtgcgttagcgtttgccgttaccaatgtctatgccgctgaattgatgaccaaagcggaatttgaaaaagttgaatcgcaatatgaaaaaataggtgatatttcaaccagtaatgaaatgtcgactgcagatgcaaaagaagatttaatcaaaaaagccgatgaaaaaggggctgatgtgttggtgctgacctctggtcaaactgacaataagattcacggcacggcaaatatttataagaagaagtaattctgaaacctatgtaaacatccccgatgcgtaagtttatcggtgatcatcatctattgaaatttatgccggataaagcgttcgcgctgcattcggcagttcagtttttcagccgccgccagaacgtcgtccggctgatacctaaataattcgccgctgctgttttatcgcctttaaatttctccagtgcctgttgtggtgtcagtaagcgtggagcgggaattttcgctgattcgcgcgctagttccggcagtagcagctgcaaaaactgcggcgttaaatccggcgtcggttccacacttaaaaacagcgccagtcgctccatcatattgcgcagttctcgaatattgcccggccagtcgtagtgcaccagcacggtttcgcttgcctgtaatccctggcgtaatgcggaagaaaacggggcagcaagtgcagccagagacactttcaaaaagctttccgccagcggcagaatatctgccacccgctcacgcagtggtggcagttgcaggcgtaaaatgctcagccgataaaacaggtcacggcgaaactgcccttgccgcatatcttcttccagattgcagtgagtggcgctaatgactcgcacatccaccggaacaggctgatgcccgccgacgcgggtgacctctttttcttccagcacccgtaacaggcgagtctgcaaaggtagcggcatttcgccaatctcatccagaaacagcgtaccgccgtgggcaatttcgaacagcccggcgcgacctccgcgtcgcgagccggtaaacgccccttcctcatagccaaacagctccgcttccagcagcgattcggcaatcgctccgcagttgacggcaacaaacggatgcgactttttgccctgtcgcgcatcgtggcgggcaaaatattcccgatgaatcgcctgggccgccagctctttgcccgtccccgtttccccttcaatcaacaccgctgcactggagcgggcatacagcaaaatagtctgccgtacctgttccatctgtggtgattgaccgagcatatcgcccagcacgtaacgagtacgcagggcgttgcgggtggcatcgtgagtgttatggcgtaacgacatgcgcgtcatatccagcgcatcgctgaatgcctggcgcacggtggcggcggaatagataaaaattccggtcattccggcttcttctgccagatcggtaattagccccgcgccgaccaccgcttcggtgccgttagctttcagctcgttaatctgcccgcgtgcgtcttcttcggtaatgtagctacgttggtcgaggcgcaaattaaaggttttttgaaacgccaccagtgccggaatagtttcctgataagtgacaacgccgatagaagaggtgagttttccggcttttgccagtgcctgtaacacatcgtagccgctcggtttaatcaaaataactggcactgacaggcggcttttcaggtacgcgccgttagagccagcggcgatgatggcgtcgcagcgttcgtttgccagtttcttgcggatgtaggtcactgctttttcaaagccaagctgaataggggtaatgttcgccagatgatcaaactcgaggctgatatcgcgaaacagctcgaacaggcgcgttacagataccgtccagataaccggtttgtcgtcattcagccgtggtggatgtgccatagcgcaccgcaaagttaagaaaccgaatattgggtttagtcttgtttcataattgttgcaatgaaacgcggtgaaacattgactgaaacgttaactgaaacgcatatttgcggattacttcatgactttatttataacaaattgaaattaaacatttaattttattcgatcaattgtggcacaccccttgctttgtctttatcaacgcaaataacaagttgataacaaaggatgggctatgtctctacactctccaggtaaagcgtttcgcgctgcactgtctaaagaaaatccattgcagattgttggcaccatcaacgctaaccatgcgctgctggcgcagcgtgccggatatcaggcgatttatctttccggcggtggcgtggcggcagggtcgctggggctgcccgatctcggtatttctacccttgatgacgtgctgaccgacattcgccgtatcaccgacgtctgctcgctgccgctgctggtagatgcggatatcggttttggttcttctgcttttaacgttgcgcgcaccgtgaaatcgatgattaaagccggtgcggcgggattgcatattgaagatcaggttggtgcgaaacgctgcggccatcgcccgaataaagcgatcgtctcgaaagaggagatggtggatcggatccgcgcggcggtggatgcgaaaaccgatcctgattttgtgatcatggcgcgcaccgatgcgctggcggttgaagggctggatgcggcgatcgagcgtgcgcgggcctatgttgaagcgggtgccgagatgttgttcccggaggcgattaccgaactcgctatgtaccgccagtttgccgatgcggtgcaggtgccaatcctcgccaacattaccgaatttggcgcaacaccgctgtttactaccgatgaattacgcagtgcccatgttgcaatggcgctgtacccgctttcagcgtttcgcgccatgaaccgcgccgccgaacatgtctacaacgtcctgcgtcaggaaggcacgcagaaaagcgtcatcgacaccatgcagacccgcaacgaactgtacgaaagcatcaactattaccagtacgaagagaagctcgacgacctgtttgcccgtagccaggcgaaataaaaaacgcccgttggttgtattcgacaaccgatgcctgatgcgccgctgacgcggcttatcaggcctacgggatgaactgaactgtaggtcggataagacgcatagcgtcgcatccgacaaccgatgcctgatgcgccgctgacgcggcttatcaggcctacggggtgaactgaactgtaggtcggataagacgcatagcgtcgcatccgacaaccgatgcctgatgcgccgctgacgcggcttatcaggcctacggggcgtgctgaactgtaggtcggataagacgtatggcgtcgcatccgacaaccgatgcctgatgcgccgctgacgcgacttatcaggcctacggggtgaactgaactgtaggtcggataagacgcatggcgtcgcatccgacaaccgatgcctgatgcgacgctgacgcggcttatcaggcctgcggggtgaactgaactgtaggtcggataagacgcatagcgtcgcatccgacaacaatctcgaccctacaaatgataacaatgacgaggacaatatgagcgacacaacgatcctgcaaaacagtacccatgtcattaaaccgaaaaaatctgtggcactttctggcgttccggcgggcaatacggcgctctgcaccgtgggtaaaagtggcaatgacttgcattaccgtggttacgatattattgatctggcggaacattgcgaatttgaagaagtggcgcatctgctgatccacggcaaactgccgacccgtgacgaactcgccgcttacaaaacgaaactgaaagccctgcgtggtttaccagctaatgtgcgtaccgtgctggaagccttaccggcggcgtcgcacccgatggatgttatgcgcaccggcgtttccgcgctcggctgcacgctgccagaaaaagaggggcataccgtctctggcgcgcgggatattgccgacaaactgctggcgtcacttagctcgattcttctctactggtatcactacagccacaacggcgaacgcatccagccggaaaccgatgacgactccatcggtggtcacttcctgcacctgctgcacggcgaaaagccatcgcaaagctgggaaaaggcgatgcatatctcgctggtgctgtacgccgaacacgagtttaacgcctccacctttaccagccgggtgattgcgggcactggctctgatatgtattccgcgattattggcgcgattggtgcactgcgcgggccgaagcacggcggggcgaatgaagtgtcgctggagatccagcaacgctacgaaacgccggacgaagccgaagccgatatccgcaagcgggtggaaaacaaagaagtggtcattggttttggtcatccggtttataccatcgccgacccgcgtcatcaggtgatcaaacgtgtggcgaagcagctctcgcaggaaggcggctcactgaagatgtacaacatcgccgatcgcctggaaacggtgatgtgggagagcaaaaagatgttccccaatctcgactggttctccgctgtttcctacaacatgatgggcgttcccaccgagatgttcacaccactgtttgttatcgcccgcgtcaccggctgggcggcgcacattatcgaacaacgtcaggacaacaaaattatccgtccttccgccaattatgttggaccggaagaccgccagtttgtcgcgctggataagcgccagtaaacctctacgaataacaataaggaaacgtacccaatgtcagctcaaatcaacaacatccgcccggaatttgatcgtgaaatcgttgatattgtcgattacgtgatgaactacgaaatcagctccaaagtagcctacgacaccgcacattactgcctgctcgacacgctcggctgcggtcttgaagctctcgaatacccagcctgtaaaaaactgctggggccaattgtccccggcaccgtcgtacctaacggcgtgcgcgtccccggaactcagttccagctcgaccccgtccaggcggcatttaacatcggcgcgatgatccgttggctcgatttcaacgatacctggctggcggcggagtgggggcatccttccgacaacctcggcggcattctggcaacggcagactggctttcgcgcaacgcggtcgccagcggcaaagcgccgttgaccatgaaacaggtgctgaccgcaatgatcaaagcccatgaaattcagggctgcatcgcgctggaaaactcctttaaccgcgtcggcctcgaccacgttctgttagtgaaagtggcttccaccgccgtggtcgccgaaatgctcggcctgacccgcgaggaaattctcaacgccgtttcgctggcgtgggtggacggtcagtcgctgcgcacctatcgccatgcgccgaacaccggcacgcgtaaatcctgggcggcgggcgatgccacttcccgcgcggtacgtctggcactgatggcgaaaacgggcgaaatgggttacccgtcagccctgactgcgcctgtgtggggcttctacgacgtctccttcaaaggtgagtcgttccgcttccagcgcccgtacggttcttacgtgatggaaaatgtgctgttcaaaatctccttcccggcggagttccactcccagacggcagttgaagcagcgatgacgctctatgaacagatgcaggcagcaggcaaaacggcggcagatatcgaaaaagtgaccattcgcacccacgaagcctgtattcgcatcatcgacaaaaaaggaccgctcaataacccggcagaccgcgaccactgcattcagtacatggtggcgatcccgctgctgttcggacgcttaacggcggcagattacgaggacaacgttgcgcaagataaacgcatcgacgccctgcgcgagaagatcaattgctttgaagatccggcatttaccgctgactaccacgacccggaaaaacgtgccatcgccaatgccataacccttgagttcaccgacggtacgcgatttgaagaagtggtggtggagtaccccattggtcatgctcgccgccgtcaggatggcattccgaagctggtcgataaattcaaaatcaatctcgcgcgccagttcccgactcgccaacagcagcgcattctggaggtttctctcgacagagctcgcctggaacagatgccggtcaatgagtatctcgacctgtacgtcatttaagcaaacagcggtaaggcgtaagttcaacaggagagcattatgtcttttagcgaattttatcagcgttcgattaacgaaccggagcagttctgggccgagcaggcccggcgtattgactggcagacgccctttacgcaaacgctcgatcacagcaatccgccgtttgcccgttggttttgtgaaggccgaaccaacttgtgtcacaacgctatcgaccgctggctggagaaacagccagaggcgctggcgctgattgccgtctcttcggaaacagaagaagagtgcacctttaccttccgccagttacatgacgaagtgaatgcggtggcctcaatgctgcgctcgctgggtgtgcagcgcggcgatcgggtgctggtgtatatgccgatgattgccgaagcgcatattactctgctggcttgcgcgcgcattggcgctattcactcggtggtgtttgggggatttgcctcgcacagcgtggcggcgcgaattgatgatgctaaaccggtgctgattgtctcggctgatgccggagcgcgcggtggcaaaatcattccctataaaaaattgctcgacgatgcgataagtcaggcgcagcaccagccacgccatgttttgctggtggatcgcgggctggcgaaaatggcacgcgtcagcgggcgggatgtcgatttcgcgtcgttgcgccatcaacacatcggcgcgcgggtaccggtggcgtggctggaatccaacgaaacctcctgcattctctacacctccggcacgaccggcaaacctaaaggcgtgcagcgtgacgttggcggatatgcggtggcgctggcgacctcgatggacaccatttttggcggcaaagcgggcggtgtgttcttttgtgcttcggatatcggctgggtggtggggcattcgtatatcgtctacgcgccgctgctggcggggatggcgactatcgtttacgaaggattaccgacctggccggactgcggcgtgtggtggaaaatcgtcgagaaatatcaggttagccggatgttctcagcgccgaccgccattcgcgtgctgaaaaaattccctaccgctgaaattcgcaaacacgatctctcgtcgctggaagtgctctatctggcgggggagccgctggacgagccgaccgccagttgggtgagcaatacgctggatgtgccggtcatcgacaactactggcagaccgaatccggctggccgattatggcgattgctcgcggtctggacgacaggccgacgcgtctgggaagccccggcgtgccgatgtatggctataacgtgcagttgcttaatgaagtcaccggcgaaccgtgtggcgtcaacgagaaagggatgctggtggtggaagggccattgccgccggggtgtattcagaccatttggggcgacgacgaccgctttgtgaagacgtactggtcgctgttttcccgtccggtgtacgccacttttgactggggtatccgcgatgctgacggttatcactttattctcgggcgcactgacgatgtgattaacgttgccgggcatcggctggggacgcgcgagattgaagagagtatctccagtcatccgggcgttgccgaagtggcggtggttggggtgaaagatgcgctgaaagggcaggtggcggtggcgtttgtcattccgaaagagagcgacagtctggaagaccgagacgtggcgcactcgcaagagaaggcgattatggcgctggtggacagccagattggcaactttggtcgcccggcgcacgtctggtttgtctcgcaattgccgaaaacgcgatccggaaaaatgctgcgccgcacgatccaggcgatttgcgaaggacgcgatcctggggatctgacgaccattgatgatcctgcgtcgttggatcagatccgccaggcgatggaagagtaaggtattgtcggatgcgtcgtgtggcgcatccgacaccgtgcgccgatgcctgatgcgacgctggcgcgtcttatcatgcctacaggtctgaaccgtaggtcggataaggcgctcgcgccgcatccgacaccgtgcgcagatgcctgatacgacgctggcgcgtcttatcatgcctacaggcctgaaccgtaggtcggataaggcgctcgcgccgcatccgacaccgtgcgccgatgcctgatgcgacgctggtgcgtcttatcatgcctacaggcctgaaccgtaggtcggataaggcgctcgcgccgcatccgacaccgtgcgcagatgcctgatacgacgctggcgcgtcttatcatgcctacaggcctgaaccgtaggtcggataaggcgctcgcgccgcatccgacaccgtgcgcagatgcctgatgcgacgctggtgcgtcttatcatgcctacaggtctgaaccgtaggtcggataaggcgctcgcgccgcatccgacaccccgcgccgatgcctgatgcgacgctgacgcgtcttatcaggcctacccactacccactgtttttacaccgataatttttcccccacctttttgcactcattcatataaaaaatatatttccccacgaaaacgattgctttttatcttcagatgaatagaatgcggcgaattttttgggtttcaaacagcaaaaagggggaatttcgtgtcgcaagataacaactttagccaggggccagtcccgcagtcggcgcggaaaggggtattggcattgacgttcgtcatgctgggattaaccttcttttccgccagtatgtggaccggcggcactctcggaaccggtcttagctatcatgatttcttcctcgcagttctcatcggtaatcttctcctcggtatttacacttcatttctcggttacattggcgcaaaaaccggcctgaccactcatcttcttgctcgcttctcgtttggtgttaaaggctcatggctgccttcactgctactgggcggaactcaggttggctggtttggcgtcggtgtggcgatgtttgctattccggtgggtaaggcaaccgggctggatattaatttgctgattgccgtttccggtttactgatgaccgtcaccgtcttttttggcatttcggcgctgacggttctttcggtgattgcggttccggctatcgcctgcctgggcggttattccgtgtggctggctgttaacggcatgggcggcctggacgcattaaaagcggtcgttcccgcacaaccgttagatttcaatgtcgcgctggcgctggttgtggggtcatttatcagtgcgggtacgctcaccgctgactttgtccggtttggtcgcaatgccaaactggcggtgctggtggcgatggtggcctttttcctcggcaactcgttgatgtttattttcggtgcagcgggcgctgcggcactggggatggcggatatctctgatgtgatgattgctcagggcctgctgctgcctgcgattgtggtgctggggctgaatatctggaccaccaacgataacgcactctatgcgtcgggtttaggtttcgccaacattactggtatgtcgagcaaaaccctttcggtgattaacggtattatcggtacggtctgcgcattatggctgtataacaattttgtcggctggttgaccttcctttcggcagctattcctccggtaggtggcgtgatcattgccgactatctgatgaaccgtcgccgctatgagcactttgcgaccacgcgtatgatgagtgtcaattgggtggcgattctggcggtcgcgctggggattgccgcaggccactggttaccgggaattgttccggtcaacgcggtattaggtggcgcgctgagctatctgatccttaacccgattttgaatcgtaaaacgacagcagcaatgacgcatgtggaggttaacagtgtcgaataacgctttacaaacaattattaacgcccggttaccaggcaaagaggggctgtggcagattcatctgcaggacggaaaaatcagcgccattgatgcgcaatccggcgtgatgcccataactgaaaacagcctggatgccgaacaaggtttagttataccgccgtttgtggagccgcatattcacctggacaccacgcaaaccgccggacaaccgaactggaatcagtccggcacgctgtttgaaggcattgaacgctgggccgagcgcaaagcgttattaacccatgacgatgtgaaacaacgcgcctggcaaacgctgaaatggcagattgccaacggcattcagcatgtgcgtacccatgtcgatgtttcggatgcaacgctaactgcgctgaaagcaatgctggaagtgaagcaggaagtcgcgccgtggattgatctgcaaattgtcgccttccctcaggaagggattttgtcgtatcccaacggtgaagcgttgctggaagaggcgttacgcttaggggcagatgtagtgggggcgattccgcattttgaatttacccgtgaatacggcgtggagtcgctgcataaaaccttcgccctgtcgcaaaaatacgaccgtctcatcgacgttcactgtgatgagattgatgacgaacagtcgcgctttgtcgaaaccgttgcagccctggcgcaccgtgaaggcatgggcgcgcgagtcaccgccagccacacaacggcaatgcactcctataacggggcgtatacctcacgcctgttccgcttgctgaaaatgtccggtattaactttgtcgccaacccgctggtcaatattcatctgcaaggacgtttcgatacgtatccaaaacgtcgcggcatcacgcgcgttaaagagatgctggagtccggcattaacgtctgctttggtcacgatgatgtcttcgatccgtggtatccgctgggaacggcgaatatgctgcaagtgctgcatatggggctgcatgtttgccagctgatgggctacgggcagattaacgacggtctgaatttaatcacccaccacagcgccaggacgttgaatttgcaggattacggcattgccgccggaaacagcgccaacctgattatcctgcctgcagaaaatgggtttgatgcgctgcgccgtcaggttccggtgcgctattcggtacgtggcggtaaggtgattgccagcacccaaccagcacaaaccaccgtatatctggagcagccagaagccatcgattacaaacggtgatcggctgggctgtgtgttgacaaagcgagcgtagtttatgccggatgcggcgtgaacgccttatccggcctacgtagagcactgaactcgtaggcctgataagcgtagcgcatcaggcaattgtgtcagtggttaccgcgattcattcccgccaacaaccgcgcatttatccaacgccatttgcaaaaatgccttcgcggcggctgtctgccagctatttttccgccgcaacaaaaccgccgttctcttcagtagtggtggggcaagagaaatagctttaagcccttcatgttgtgtggcaatcgctgctggcaacaatgtggaaagggaagtgcggcgaatcagctccagaaccgcgctaattgagttcgcctcaatgaccacctgtggatgtagccccgctttctcacagtagtggtcaatttgctctctggtggcaaattccgcgctgagcaggaccagtttttcatcatgcaagcgactcaacgccacctgttcacaggcagccagcggatgatgttgcgccacgactaacgctaaactttctgtcagtaaaggaattgcctccagctccggcgaatgcacaggcgcgaaggcaatcccaacgtccaactcgtcgcgacaaagcagatcttcgattttctcctgcgacatttcctgtagcttgagcgtgatgccggggtagcgcgcatagaaatccgccattaaagggccgataaagtagctcgtaaaggtgggggtgacggcgatacgcagcgatcctcgcgtcagatcggcaacatcatgaatcgcccgtttacccgcccccagttcctgtaacgcccggctggcgtactgtcgccagacttctcctgcatcagtgagacgaatcgttcgcccgctacggtcaaacagcggcacgcctaaactctcctctaactggcgaatctgctgggaaagcgcaggctgggagacgtgcaacgcactggcggcacgggtaaagctgccatgttcagccacggcaagaaaataattgatatgtcgagagagcattcgccaacctataagtaaatccaatagaactcatcataaatgagacttttaccttatgacaatcggcgagtagtctgcctctcattccagagacagacagaggttaacggtgaaagagattattgatggattccttaaattccagcgcgaggcatttccgaagcgggaagccttgtttaaacagctggcgacacagcaaagcccgcgcacactttttatctcctgctccgacagccgtctggtccctgagctggtgacgcaacgtgagcctggcgatctgttcgttattcgcaacgcgggcaatatcgttccttcctacgggccagaacccggtggcgtttctgcttcggtggagtacgccgtcgctgcgcttcgggtatctgacattgtgatttgcggtcattccaactgtggcgcaatgaccgctattgccagctgccagtgcatggaccatatgcctgccgtctctcactggctgcgttatgccgattctgcccgcgtcgttaatgaggcgcgcccgcatcgtgatttaccgtcaaaagctgcggcgatggtgcgtgaaaacgtgattgctcagttggctaatctgcaaacgcatccatcggtgcgcctggcgctcgaagaggggcggatcgccctgcacggctgggtctacgacattgaaagcggcagcatcgcagcttttgacggcgcaacccgccagtttgtgccactggccgctaatcctcgcgtttgtgccataccgctacgccaaccgaccgcagcgtaaccttatttttaaaccatcaggagatcctccatgattcagtcgcaaattaaccgcaatattcgtcttgatcttgccgatgccattttgctcagcaaagctaaaaaagatctctcatttgccgagattgccgacggcaccggtctggcagaagccttcgtaaccgcggctttgctgggtcagcaggcgcttcctgccgacgccgcccgccaggtcggggcgaagctggatctcgacgaagacgctattctactgttgcagatgattccactgcgtggctgcattgatgaccgtattccaaccgacccaacgatgtatcgtttctatgaaatgttgcaggtgtacggcacaaccctgaaagcgttggttcatgagaagtttggcgatggcattatcagcgcgattaacttcaaactcgacgttaagaaagtggcggatccggaaggtggcgaacgcgcggtcatcaccttagatggcaaatatctgccgaccaaaccgttctgacaaccatgcgcgaccatcaaaagacgttcacgatgctgctggttctggtgctgattggtcttaatatgcgaccactgctcacctccgtcggaccactgctaccgcaattgcgtcaggcgagtggaatgagctttagcgtggcagccctgttgactgctctgccggtggttaccatgggcgggctggcgctggccggaagctggcttcatcagcatgtcagcgaacgtcgcagcgtcgccatcagtttgttactgattgccgtcggtgcattgatgcgtgagctttacccccaaagtgcgctgctgcttagcagcgcactgcttggtggagtggggatcggcatcattcaggcagtgatgccttcggtaattaagcggcggtttcagcaccgtacgccactggtgatggggctgtggtccgcggctctgatgggcggcggtggacttggtgccgccattacgccctggttagttcaacatagcgaaacctggtatcaaacactcgcctggtgggcgctgcctgccgttgttgcgctctttgcctggtggtggcaaagcgcccgcgaggtcgcctcttctcacaagacaacaaccactccggttcgcgtggtatttactccccgcgcctggacgctgggtgtttacttcggtctgattaacggcggttacgccagcctgattgcctggttacccgctttctatattgagattggtgccagcgcgcagtacagcggttccttgctggcattgatgacgcttgggcaagcagcaggggcattgctaatgcctgctatggctcgccatcaggatcggcgcaaacttttgatgctggcgctggcgttacaactggtggggttctgcggctttatctggctgccgctgcaattgccggtattgtgggcaatggtgtgtgggttaggtctgggcggcgcatttccgctctgtttgctgctggcgctcgatcactctgcgcaacccgctattgctggcaaactggtggcgtttatgcaggggatcggttttatcatcgccgggcttgccccgtggttttctggtgtgctgcgtagtatcagtggcaattacttgatggactgggcgtttcatgcgctgtgcgtcgttgggctgatgatcataaccctgcgttttgcaccagcacgttttccgcagctgtgggtcaaagaggcatgatgcgacgcttgtttcgccagataatggaagagtgaattattgtcggatgtgcccaatggcgcatccgacatttatttcagtgctaatttaaactgaaggttcaactttataatctttgtaataatagtgcttatcccggtcgtttatttcgcgaataacccggcaaggaacgccagcagccacgacgtttggtggaatgtcttttatgacgacactacccgcgccaataacagaattatccccgatggtgacgcctggattaatgaccacatgacttccgatccagacgttattgccaatcgttatcggaaaagagtacatctcaccgttttttcttaattcatggtgtaccgggtgtcccgtaacggaaagagtaacgttgggtgcaatcagtacgttatcaccgattgttaccgtgtagtcatcgacaatggttaaattaaaatttgcataaaaattgcggcctatatggatgttggaaccgtaagagaaatagacgggaggttctacccaggcgttttcccctaccgtggcaaacatttctttaatcaggctttctcttttttcaacttctgatggatgcgagtgattaaactcatacattaacgttttcccacgaagtcttttttccggtaagccttcgcacatatcggtaaatagcttgcctgcttttattctttcggtcattggcatgttcattgcgatcattccgttatgatatgttggtcggataaggcgctcgcgccgcatccgacattgattgcttaagcgacttcattcacctgacgacgcagtagagaaagcggaccggggccgctaagcgtgaacacggaaattaaggtgaagcccaacgccaccagacccagcaccagataagcgccctggaaaccgatgctttcatacatattgcccgccagtacagacataaaaatcatcgccagttgcttaaagaagcagaaacagaccagataaatcgtcgctgaaaaacgcacttcaaactggctggtaatatatttaaagcagcccaccagcaggaacggtacttcaaacatatgcagcgttttcagaataaccacttccagcgctgaggtggcgaacgatgagccaataatacgtacagacataatagtgccagccagcagcagggcgtttttcccaccgatgcgattaatgatcagcggcgcgaagaacataatcgaggcgttaagtaattcgcccattgtcgttacgtagccaaatacccgcgtaccctgttcaccggtggcaaagaacgaagtaaagaaattagcaaactgttggtcaaaaacatcgtaggtgcaggaaacgccaataacatacagtgacaaaaaccacagttttggctgtctgaacagttccagcgccagcttaaggctaaatgccgaatggttggcacctaccgcattggcaaccgtggcggaagagggtgcatccgttttggcgaaaaagagcaaaacggcgaggatgagtgcacagccagaacccagccagaaaacaaactgattattgatggtgaacatgatgccgacaatcgaggcacacagcgcccagccaacacagccaaacatccgcgcgcgaccaaattcgaaattactgcgacggctgactttctcgataaatgcctctactgctggcgcaccggcgttaaaacaaaagccaagataaataccaccaacaatcgatcctactaaaatgttgtattgtaacagtggcccgaagataaaaataaagaacggcgcaaacatcactaacatgccggtaataatccacagcaggtatttgcgcagcccgagtttgtcagaaagcagaccaaacagcggttggaataatagcgagaacagagaaatagcagcaaaaataatacccgtatcacttttgctgatatggttgatgtcatgtagccaaatcgggaaaaacgggaagtaggctcccatgataaaaaagtaaaagaaaaagaataaaccgaacatccaaaagtttgtgttttttaaatagtacataatggatttccttacgcgaaatacgggcagacatggcctgcccggttattattatttttgacaccagaccaactggtaatggtagcgaccggcgctcagctggaattccgccgacactgacgggctccaggagtcgtcgccaccaatccccatatggaaaccgtcgatattcagccatgtgccttcttccgcgtgcagcagatggcgatggctggtttccatcagttgttgttggctgtagcgactgatattgaactggaagtcgccgcgccactggtgtgggccataattcaattcgcgcgtcccgcagcgcagaccgttttcgctcgggaagacgtacggggtatacatgtctgacaatggcagatcccagcggtcaaaacaggccgcagtaaggcggtcgggatagttttcttgcggccctaatccgagccagtttacccgctctgcgacctgcgccagctggcaggtcaggccaatccgtgccggatgcggtgtatcgctcgctacttcaacatcaacggtaatcgccatttgaccactaccatcaatccggtaggttttccggctgataaataaggttttcccctgatgctgccacgcgtgagcggtcgtaatcagcaccgcgtcggcaagtgtatctgccgtgcactgcaacaacgctgcttcggcctggtaatggcccgccgccttccagcgttcgacccaggcgttagggtcaatgcgggtcgcttcacttacgccaatgtcgttatccagcggtgcacgggtgaactgagcgcgcagcggcgtcagcagttgtttttcatcgccaatccacatctgtgaaagaaagcctgactggcggttaaattgccaacgcttattacccagctcgatgcaaaaatccatttcgctggtggtcagatgcgggatggagtgggacgcggcggggagtgtcacgctgaggttttccgccagacgccactgatgccaggcgctgatgtgtccggcttctgaccatgcggtcgcgttcggttgcactacgtgtaccgttagccagagttgcccggtgctttccggctgcggtagtacaggcagttcaattacctgtttaccttgtggagcgacatccagaggcacttcaccgcttgccagcggcttgccatccagtgccaccgtccagtgcaggagctcgttatcgctatgacggaacaggtattcgctggtcacttcgatggttcgcccggataaacggaactggaaaaactgctgctggtgttttgcttccgtcagcgccggatgcggcgtgcggtcggcaaagaccagaccgttcatgcagaactggcgatcgttcggcgtatcgccaaaatcaccgccgtaagccgaccacgggttgccgttttcatcatatttaatcagcgactgatccacccagtcccagacgaagccgccctgtaaacgggggtactgacgaaatgcctgccagtatttagcgaagccgccaagactgttacccattgcgtgggcatattcgcaaaggatcagcgggcgcagttctccaggcagcgaaagccattttttgatggaccatttcggcacagccgggaagggctggtcttcatccacgcgcgcgtacatcgggcaaataatatcagttgcggaggtgtcggctccgccgccttcatactgcaccgggcgggaaggatcgacagatttgatccagcgatacagtgcgtcgtgattagcgccgtggcctgattcattccccagcgaccagatgatcacactcgggtgattacgatcgcgctgcaccattcgcgttacgcgttcgctcatcgcgggtagccagcgcggatcatcggtcagacgattcattggcaccatgccgtgggtttcaatattggcttcatccaccacatacaggccgtagcggtcgcacaacgtgtaccacagcggatgattcggataatgcgaacagcgcacggcgttaaagttgttctgcttcatcagcaggatatcctgcaccatcgtctgctcatccatgacctgaccatgcagaggatgatgctcgtgacggttaacgccgcgaatcagcaacggcttgccgttcagcagcagcagaccattttcaatccgcacttcgcggaaaccgacatcgcaggcttctgcttcaatcagcgtgccgtcggcggtgtgcagtttaaccaccgcacgatagagattcgggatttcggcgctccacagcgccgggttttcgacgttcagacgtagcgtgacgcgatcggcataaccaccacgctcatcgataatttcaccgccgaaaggcgtggtgccgctggcgacctgcgtttcaccctgccacaaagaaaccgtcacccgcagctcatcgcgcagttcgccgcacatctgaacttctgcctccagtaccgcgcggctgaaatcatcattaaagcgagtggcaacatggaaatcgctgatttgtgtggtcggtttgtgcagcaacgagacgtcacggaaaatgccgctcatccgccacatatcctgatcttccagataactgccgtcactccagcgcagtaccatcaccgcgaggcggttttctccggcgcgtaaaaatgcgctcaggtcaaattcagacggcaaacggctgtcctggccgtaaccgacccagcgcccgttgcaccacaaatgaaacgccgaattaacgccatcaaaaataattcgcgtctggccttcctgtagccagctttcatcaacattaaatgtgagcgagtaacaacctgtcggattctccacgggaacaaacggcggattgaccgtaatgggataggtcacgttggtgtagatgggcgcgtcgtaaccgtgcatctgccagtttgaggggacgacgatagtatcggcgtcaggaagatcgcactccagccagctttccggcaccgcttctggtgccggaaaccaggcaaagcgccattcgccattcaggctgcgcaactgttgggaagggcgatcggtgcgggcctcttcgctattacgccagctggcgaaagggggatgtgccgcaaggcgattaagttgggtaacgccagggttttcccagtcacgacgttgtaatacgacggccagtgaatccgtaatcatagtcatagctgtatcctgtgtgaaattgttatccgctcacaattccacacaacatacgagccggacgcataaagtgtaaagcctggggtgcctaatgagtgagctgactcacattaattgcgttgcgctcactgcccgctttcgagtcgggaaatttgtcgcgccagctgcattaaagaatctgccaacgcctggggagaagcggtttgcgtattgggcggaagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacacgagctgtcttcggtatcgtcgtatcccactaccgagatatccgcaccaacgtgcagcccggactcggtaatggcgcgcattgcgcccagcgccatctgatcgttggcaaccagcatcgcagtaggaacgatgtcctcattcagcatttgcatggtttgttgaaaaccggacatggcactccagtcgccttcccgttccgctatcggctgaatttgattgcgagtgagatatttatgccagcccgccaggcgcagacgtgccgagacagaacttaatggacctgctaacagcgcgatttgctggtgacccaatgcgaccagatgctccacgcccagtcgcgtaccgtcttcatgggagaaaataatactgttgatgggtgtctggtcagagacatcaagaaataaagccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgcttgcccgccagttgttgtgccacgcggttgggaatgtaattcagctccgccatcgccgcttctactttttcccgcgttttcgcagaaacgtggctggcctggttcaccacgcgggaaacggtctgataagagacaccggcatactctgcgacatcgtatagcgttactggtttcacattcaccaccctgaattgactctcttccgggcgctatcatgccataccgcgaaaggttttgcgccattcgatggtgtcaacgtaaatgcatgccgcttcgccgtccggccaccagaatagcctgcgattcaaccccttcttcgatctgttttgccacccgttgtagcgccggaagatgcttttccgctgcctgttcaatggtcattgcgctcgccatatacaccagattcagacagccaatcacccgttgttcactgcgcagcggtacggcaatagaggcgatcttttcttcttgatcccagccgcggtagttctgtccgtacccctctttgcgcgcgcgcgccagaatggcttccagctttaacggttcccgtgccagttgatagtcatcaccggggcgggaggctaacatctcgattaattccttgcgttcttgttccgggcaaaaggccagccaggtcaggcccgaggcggttttcaggagcggtaaacgtcgcccgaccattgcccggtgaaaggataagcggctgaaacggtgagtggtttcgcgtaccaccattgcatcaacatccagcgtggacacatctgtcggccataccacttcgcgcaacagatcgcccagcagtggggccgccagtgcagaaatccactgttcgtcacgaaatccttcgcttaattgccgcactttgatggtcagacgaaaactgtcatcggagggactacgccggacatatccctcttcctgcagcgtctccagcagtcgccgcacagtggtgcgatgcaggccgctgagttccgccagcagcccgacgctggcaccgccatcaagtttatttaacatatttaataacattagaccgcgggttaagccgcgcacggttttgtattccgtctgctcattgttctgcatattaattgacatttctatagttaaaacaacgttgtgcacctggtgcacattcgggcatgttttgattgtagccgaaaacacccttcctatactgagcgcacaataaaaaatcatttacatgtttttaacaaaataagttgcgctgtactgtgcgcgcaacggcattttgtccgagtcgtgaggtactgaaatggcaatacaacaccctgacatccagcctgctgttaaccatagcgttcaggtggcgatcgctggtgccggtccggtcgggctgatgatggcgaactatctcggccagatgggcattgacgtgctggtggtggagaaactcgataagttgatcgactacccgcgggcgattggtattgatgacgaggcgctgcgcaccatgcagtcggttggcctggtcgataatgttctgccgcacactacgccgtggcacgcgatgcgttttctcaccccgaaaggccgctgttttgctgatattcagccaatgaccgatgaatttggctggccgcgccgtaacgcctttattcagcctcaggtcgatgcggtgatgctggaaggattgtcgcgttttccgaatgtgcgctgcctgttttcccgcgagctggaggccttcagccagcaagatgacgaagtgaccttgcacctgaaaacggaagaagggcagcgggaaacggtcaaagcccagtggctggtggcctgtgatggtggggcaagttttgtccgtcgcaccctgaatgtgccgtttgaaggtaaaactgcgccaaatcagtggattgtggtagatatcgccaacgatccgttaagtacgccccatatctatttgtgttgtgatccggtgcgcccgtatgtttctgccgcgctgcctcatgcggtacgtcgctttgaatttatggtgatgccgggagaaaccgaagaacagctgcgtgagccgcaaaatatgcgcaagctgttaagcaaagtgctgcctaatccggacaatgttgaattgattcgccagcgtgtctatacccataacgcgcgactggcgcaacgtttccgtattgatcgcgtactgctggcgggcgatgccgcgcacatcatgccggtgtggcaggggcagggctataacagtggtatgcgcgacgcctttaacctcgcatggaaactggcgttggttatccaggggaaagcccgtgatgcgctgctcgatacctatcaacaagaacgtcgcgatcacgccaaagcgatgattgacctgtccgtgacggcgggcaacgtgctggctccgccgaaacgctggcagggtacgttacgtgacggcgtttcctggctgttgaattatctgccgccagtaaaacgctacttcctcgaaatgcgcttcaagccgatgccgcaatattacggcggtgcgctggtgcgtgagggcgaagcgaagcactctccggtcggcaagatgtttattcagccgaaagtcacgctggaaaacggcgacgtgacgctgctcgataacgcgatcggcgcgaacttcgcggtaattggctggggatgcaatccactgtgggggatgagcgacgagcaaatccagcagtggcgcgcgttgggcacacgcttcattcaggtggtgccggaagtgcaaattcataccgcacaggataaccacgacggcgtactacgcgtgggcgatacgcaaggtcgcctgcgtagctggttcgcgcaacacaatgcttcgctggtggtgatgcgcccggatcgctttgttgccgccaccgccattccgcaaaccctgggcaagaccctgaataaactggcgtcggtgatgacgctgacccgccctgatgccgacgtttctgtcgaaaaggtagcctgatatgcacgcttatcttcactgtctttcccactcgccgctggtggggtatgtcgacccggcgcaagaggtgctcgatgaggtcaatggcgtgattgccagcgcccgcgagcgtattgcggctttctcccctgaactggtggtgctgtttgcgccagatcactacaacggctttttctatgacgtgatgccaccgttctgtttaggcgttggagcgacggcaattggtgatttcggtagtgcggcaggagagctgcccgtgcctgttgagctggcggaggcctgtgcgcatgccgtcatgaagagcgggatcgatcttgccgtttcttactgtatgcaggtggaccacgggttcgcccagccgctggagttcctgctcggcgggctggataaggtgccggttttgcctgtgttcatcaacggtgtcgccacgccgttgcccggtttccagcgtacccgcatgttgggtgaagccattggacgtttcaccagtactctcaataaacgcgtgctgttcctgggttccggtgggctttcccatcagccgccggtgccagaactggcgaaagccgatgcccatatgcgcgaccgtctgttggggagcgggaaagatttacccgccagtgagcgcgaattgcgtcagcaacgggtgattagcgccgctgagaagtttgttgaggatcagagaacgctgcatcccctcaacccgatttgggataaccagttcatgactttgctggagcagggacgcatacaggaactggatgccgtcagtaacgaagagctttccgccattgccggaaagtcgacacatgaaatcaaaacctgggtcgccgcttttgccgctatttctgcgtttggcaactggcgtagcgaagggcgttattaccgcccaatcccggagtggattgccggatttggctcgttaagcgccagaacagagaactgaatatgcaggagaagatgatgagttatcagccacaaaccgaagccgccaccagtcgttttctgaatgtagaagaagcgggtaaaacgctgcgcatccattttaatgactgcggacaaggcgacgaaactgttgtcctgctgcatggttccggcccgggtgctactggctgggcgaacttcagccgcaatatcgatccgctggtagaggcgggctatcgggtgatcctgctggattgtccgggttggggtaagagcgattcgatcgttaatagtggttcgcgatcggatcttaatgcgcgaatcctgaaaagcgtggtggatcaactggatatcgccaaaatccacctgctgggcaactcgatgggcggccacagttctgtggcgttcactcttaactggccggagcgcgtcggcaaactggtgctgatgggcggcggtacgggcggcatgagtttgtttacgccgatgccaaccgaaggtattaagcgactgaatcagctttatcgtcagccgactatcgaaaacctgaagctgatgatggatatcttcgtttttgataccagcgatttgaccgacgccctgtttgaagcgcgcctgaataatatgctgtcgcgccgcgatcacctggaaaacttcgttaagagcctggaagccaatccgaaacagttcccggattttggcccacgtctggcggaaatcaaagcgcaaaccctgattgtctgggggcgcaacgaccgctttgtgccgatggatgcgggtctgcgtctgctgtccggcattgccggttctgaactgcatatcttccgcgactgtggtcactgggcgcagtgggaacatgccgacgctttcaatcaactggtgctgaatttcctcgcacgcccttaaggaacggtcatgacgaagcatactcttgagcaactggcggcggatttacgccgcgccgcagagcagggcgaagcgattgcgccgctgcgcgatctgattggtattgaaaacgctgaagcggcctacgccattcagcgcatcaatgtgcaacatgacgttgcgcaggggcgtcgcgtggtggggcgtaaagtgggcctgacgcatccgaaagtgcagcaacaactgggcgttgatcaaccggatttcgggacattatttgccgacatgtgttatggcgataacgaaaccattcctttttcccgtgttctgcaaccccgcattgaagcggagattgcactggtgttgaaccgcgatttgcccgcaaccgatatcaccttcgacgaactgtataacgtcattgaatgggtacttccggcgctggaggtggtgggtagccgcattcgcgactggtcgattcagtttgtcgataccgtggcagataacgcctcctgtggggtgtatgtcatcggcggtccggcgcaacgtccggcggggttagacctgaaaaactgcgccatgaagatgacgcgtaataacgaagaggtttccagcgggcgcggcagcgaatgcctgggacatccgcttaatgccgccgtctggctggcacgcaaaatggccagcctgggtgaaccgctgcgcgccggagatatcattcttaccggggcattaggtccgatggtggcggtgaatgcgggcgatcgttttgaagcccatatcgaaggcataggttcagttgctgcgacattttcaagcgcagccccaaaaggaagtctgtcatgagtaagcgtaaagtcgccattatcggttctggcaacattggcaccgatctgatgattaaaattttgcgtcacggtcagcatctggagatggcggtgatggtcggcattgatcctcagtccgacggtctggcgcgtgccagacgtatgggcgtcgccaccacccatgaaggggtgatcgggctgatgaacatgcctgaatttgctgatatcgacattgtatttgatgcgaccagcgccggtgctcatgtgaaaaacgatgccgctttgcgcgaagcgaaaccggatattcgcttaattgacctgacgcctgctgccatcggcccttactgcgtgccggtggttaacctcgaggagaacgtcgatcaactgaacgtcaacatggtcacctgcggcggccaggccaccattccaatggtggcggcagtttcacgcgtggcgcgtgttcattacgccgaaattatcgcttctattgccagtaaatctgccggacctggcacgcgtgccaatatcgatgaatttacggaaaccacttcgcgcgccattgaagtggtgggtggcgcggcaaaagggaaggcaattatcgtgcttaacccagcagagccaccgttgatgatgcgtgacacggtgtatgtattgagcgacgaagcttcacaagatgatatcgaagcctcaatcaatgaaatggctgaggcggtgcaggcttacgtaccgggttatcgcctgaaacagcgcgtgcagtttgaagttatcccgcaggataaaccggttaatttgccgggcgtggggcagttctccgggctgaaaacagcggtctggctggaagtcgaaggcgcagcgcattatctgcctgcctatgcgggcaacctcgacattatgacttccagtgcgctggcgacagcggaaaaaatggcccagtcactggcgcgcaaggcaggagaagcggcatgaacggtaaaaaactttatatttcggacgtcacgttgcgtgacggtatgcacgccattcgtcatcagtattcgctggaaaatgtccgccagattgccaaagcactggacgatgcccgcgtggattcgattgaagtggcccacggcgacggtttgcaaggttccagctttaactatggtttcggcgcacatagcgacctagaatggattgaagcagcggcggatgtggtgaagcacgccaaaatcgcgacgttgttgctgccaggaatcggcactattcacgatctgaaaaatgcctggcaggctggcgcgcgggtggttcgtgtggcaacgcactgtaccgaagctgatgtttccgcccagcatattcagtatgcccgcgagctcggaatggacaccgttggttttctgatgatgagccatatgaccacgccggagaatctcgcaaagcaggcaaagctgatggaaggctacggtgcgacctgtatttatgtggtggattctggcggtgcgatgaacatgagcgatatccgtgaccgtttccgcgccctgaaagcagagctgaaaccagaaacgcaaaccggcatgcacgctcaccataacctgagtcttggcgtggcgaactctatcgcggcggtggaagagggctgtgaccgaatcgacgccagcctcgcgggaatgggagcgggcgcaggtaacgcgccgctggaagtatttattgccgccgcggataaactgggttggcagcatgggaccgatctctatgcgttaatggatgccgctgacgacctggtgcgtccgttgcaggatcgaccggtacgagtcgatcgcgaaacgctggcgctgggatacgctggtgtttactccagcttcctgcgtcactgtgaaacggcggcggcgcgttatggcttaagcgcggtggatattctcgttgagttgggcaaacgccggatggttggcggtcaggaggatatgatcgtcgatgtggcgctggatctgcgcaacaacaaataatgatgactgccgagaacgtgcattttgtatgcccatcccagcacgactgccggatgcggcgtaaacgccttatccggcctatatttcgcccgtaggcagtcattaaatggttctgattacgcggctgacaatgtatcagccgcgattcacctgcactcgcaacgaggttcatcttatgtcgactcgtaccccttcatcatcttcaacccgcctgatgctgaccatcgggctttgttttttggtcgctctgatggaagggctggatcttcaggcggctggcattgcggcgggtggcatcgcccaggctttcgcactcgataaaatgcaaatgggctggatattcagcgccggaatactcggtttgctacccggcgcgctggttggcggaatgctggcggaccgttatggtcgtaagcgtattttaattagctcagttgcgctgtttggtttgttctcactggcaacggcgattgcctgggatttcccctcactggtctttgcgcgactgattaccggtgtcgggctgggggcggcgttgccgaatctgatcgccctgacgtctgaagccgcggggccacgttttcgtgggacggcagtgagcctgatgtattgcggtgttcccattggcgcggcgctggcggcgacactgggtttcgcgggggcaaacttagcatggcaaacggtgttttgggtaggtggtgtggtgccgttgattctggtgccgctattaatgcgctggctgccggagtcggcggtgttcgctggcgaaaaacaggccgcgcctccactgcgtgcgttatttgcgccagaaacggcaaccgcgacgctgctgctgtggttgtgttatttcttcactctgctggtggtctacatgttgatcaactggctaccgctgcttttggtggagcaaggattccagccatcgcaggcggcaggggtgatgtttgcactgcaaatgggtgcggcaagcgggacgttaatgttgggcgcattgatggataagctgcgtccagtaaccatgtcgctactgatttatagcggcatgttagcttcgctgctggcgctgggaacggtgtcgtcatttaacggtatgttgctggcgggattcgtcgcggggttgtttgcgacaggtgggcaaagcgttttgtatgccctggcaccgttgttttacagttcgcagatccgcgcaacaggtgtgggaacagccgtggcggtagggcgtctgggggctatgagcggtccgttactggccgggaaaatgctggcattaggcactggcacggttggcgtaatggccgcttctgcgccgggtattcttgttgctggcctggcagtgtttattttgatgagccggagatcacgaatgcagccgtgcgccgatgcctgacgcgccttattaagcagggacgaaagggacttgccccaatacacctacggcgtttacaggtatactcgctaaaaattattcagcgggtttggaaacaaagatggcaaaacttaccttacaagagcagttgctcaaagcaggattagtcaccagcaaaaaagcggcgaaggtcgagagaacggcgaaaaaatcgcgcgttcaggcgcgtgaagctcgggcggcggtagaagaaaataaaaaggcacagcttgaacgtgataaacagcttagcgagcagcaaaaacaagcggcgttggcgaaagaatataaagctcaggtgaagcagctcattgaaatgaaccgaatcaccattgttaatggcgatattggttttaacttcactgacggtaatctgattaagaaaatctttgtcgataagctcacgcaagcgcagttaattaatggtcgtctggcgattgcccgcttgttgctcgataacaatagcgaaggtgaatacgccattattcccgccagcgttgccgataaaattgctcagcgtgatgccagcagtattgtgttgcacagcgcgctcagtgccgaagagcaggatgaagacgatccgtatgccgacttcaaagtgcctgatgatttgatgtggtaaacatagataagtcgtgcgcagatgcctgatgcgacgctatgcgcgtcttatcatgcctacggcctgcgggcgaaatgtaggcggataaggcgttcacgccgcatccggcagtcgtgcactattattaacgcatattcagtttattggcgtgataggcaatatgctcgccaataaaactggagacaaaataatagctgtgatcataaccctcgtgataacggattaacgtcttgatattcatctcctggcagatcttttcaagatttggagtccgcagctgttctgcgtaaaaatcatcactcaacccctgatcaaccatgatttccgcaacgcgttgaccttgtgaaataaggctcaccgggtcgtaatccaaccaggcttctttattttcaccaagatatgcggtaaaggcttgctgtccccacggtacttgcgatggggagacaatgggcgaaaacgctgagacgctgacatattcatctggattacgtaacgccagcaccagtgcgcccagcccgcccatagaatgacctgagatagactttctggccgttgccggaaaatgttgcatcactaaatccggcagctcgttgcggatatagtcatacattttgtaatgttcattccacggcgcttgcgttgcgttcaggtaaaacccggcaccttgcccgagatcgtaacggtcagcatctgcgacatgactgcctcgcggactggtgtccggcgcaacaacaataatgttgtgctcagccgcgtaacgttgcatccccgatttagtaatgaaattctgctcgttgcaagtcagccctgaaagccagtacaacaccggcaatttttcacttgcggcttttggtgggagatagacgccgacattcatttcacatttcagtgatggggaataatgccgatacacattttgccagccgccaaagctggcatgtttttcaatgagttccatcagtcattatctcacggttaatcccccggacggctgcccggggagagtattaagaaccccgtctgaactggacgggtaaacctgcgggaaatcagtaacgaattacggttcgaatggatttgccttcatgcatcaggtcaaaggcgtcattaatttcatccaggctcatggtatgcgtgacaaacggttccagatcgatatcgcctttcatcgcatcttcaaccatacccggtaactgggaacgacctttcacgccgccaaacgcggaacctttccatacgcgaccggtgaccaactggaatggacgggtggagatttcctgaccagaaccagctaccccgatgatcaccgactgaccccagccgcggtgcgcactttccagcgccgcacgcatcacgttgacgttaccgatgcattcaaaggtatggtcgataccccatttgttgatatccagcaggacatctttaatcggtttgtcgtagtcattcgggttaatgcagtcggtggcaccgaagcgacgcgccagatcgaatttcttcgggttcgtatcaatagcgataatccgtcccgctttcgcctgacgcgcgccctgaaccactgccagaccaatcgcgccaagaccaaatacggcaacagaatcacctggctggactttagccgtgttgtgtaccgcgccaataccggtggtcacgccacagcccagcaggcagacgtgttcatggtttgcttctggattaattttggccagagacacttccgcgaccacggtgtattcactgaatgtagagcatcccatgtagtgataaagcggctgcccgttgtaagaaaaacgggtggtgccgtctggcatcaggcctttaccctgggtttcgcgaaccgcaacacagaggttggttttgccggaacgacagaactcacactcgccgcactctgcggtgtaaagcgggatcacatggtcgccaggtttgacgctggttacgccttcaccgacttcaaccacaacgccggccccttcgtgaccgagaactaccgggaatacaccttccgggtcatcgccggagagggtaaatgcgtcggtatggcaaacgccggtatgggtgactttaatcagcacttcaccttttttcggtggtgcaacgtcaatttcaacgatttccagcggtttaccgggagcaaatgcaacggcagcacgtgatttcatctctcgctcttcctcaatatggtaatagattcagctatttaagataggcacgaaccagttcaatagtgtcgtcaacggattggctgacttcgcggctgtagcagtcatttcggtcaaacgtttcccggatatggctttcaagcacttctgccatcagcccgttagccgcgccccgaacggcagcgatctgttggagtatggcacggcattcggcatcaccctccagcgaccgttccagagcatcaatctgcccccgaatacgacgaactcgagtaaggacctttttcttctcttccggagtactgggcatttcgcacctcatcatctgcatgcaatatactataggggggtatgctatatgtcaatgcatacccccctatagtatataacactggagaataaaatttatccggtgaatgtggtcggaaaacaaagaggaaagggggtggggctaatcggcagggaaggccgccccggatagcgggcggcagaagcaatcagaatttccaggtcagatgggctgcaagttgcagaccgttataatcatcggttggggtgtcgtaccacactttacctgccgtcagcccgagattaagttgctcagtcagcggttgaatacgttgcaaactgacgctcttcatgctgccgtagcgtgtttctggcgtccagtcataggtgtaagcacctgttccgcggcttagccatagttgcgtataaccagtgccgcgcgggtcattcagacgcacggaaatcatattgctgtaactaccacctgcatcgctggagtcataatgggtatagcggtagctggagatcaccgggccagtatagagtgatacgccgccttgccaggcatcgacttcgacatcatcgtaatatttagtgtagcgataaccggtcgtgaaaagcgtttttggcaacagtgccaggttaatatcctgacgaaaatcctggcgggcaaagaccggcgtattatccgcaaaggcaatacccattcgggttgtcagccagttattccatttataccagaccgcaccctgaccgcgagtggcattgaaatgttcagtttcataatcacgacgcccctgggaaagattaaaaagcagcgttgcgttttcaactttcgccaccagttcagcatacgctaaattacggttgccatgatcgccagaataatcggtaaaatcgtagcccgcggtaatggaagttaacccggcataagcgggcaatgtgctaaaaattgctgccgctaataacgtccgttttatcattttaatctcctgtacggataagttcttgtcggagtgaataagttccgggaggtaaattacgttctacaatcacgcgcgggccaagttgcgtgttcggggaaataattcgcccaggcaaaataataacttgtacgccaaggcgtgaacgctgcccgatataacaacctaatttatcgcatccggtagcgataattccctctggagttcgaacagacacgggctgttgatccagacgatgattactggtacgtacttgtgcgcccaaatatgcctggtttgcaactaccgagtcggcgataaagcattgcggaccaatcgttgcttccgcttcaataaccgcatttttaatttcggtggcgaaaccaatttttacgccattgctgattattgtgccaggacgaataaacgcataattacctatcaggcagtttgcgccaatcactaccggaccctgaataacggcaccgtgacaaatacgggtattcgcgccgataacaacttcacctgcagtttcatcaataattacctggtctgcaatctgaatatttttctctttaacattaagcttcagaaagtttttcagttcctgtgacagaaggttgggaataagaggttgacgcttccaccagtgcggaatagcgggtgggtttgtcgcgctgaggttcgcgtccagtaaaaaaggcaataagtccataaataatccagatggcataagctaataatacatacacaacggaaagcggtgctaaaggcaccaacaaccagcaacgatgaaaccaggcgctaaaagcaccaataacacaaactacgccgacccagataagcggaaacattgccaacaccacaccatacggcccggtggtgatgaattcattaaaccaggtagtgagataaatcccaacgccataaagcacaaccaacagcataggaaatatactgaagataccgaagcggctaaataaaagccttttatgcaggcgcatacagaccgcgtagcccacaatccaacgccgccagcgacgccattcctcacgcgggctgttgcattcctgtgggtatacgatgcagcgattcgcctgccgaatacgatagccgtttgccaccaatgtccaggtgagatcaaggtcttcgactttagtacgatcagagaaaccgaacttacgcaatacatcagtacggaacatcccgcaggcaccgctgataataaacggtgcgccgcccaggagctgctgtagcgtgcgcttcataacaatcatcggcaactttacggtcgcgcggatgtgcggtaacagacccgcgcctttcaacgcagtagagggaatgccgcctacggcatcagcaccgcgctctatttctgcaagcatatagcccattccgtcttgatcgggcggaacataggtgtcggcatcacttaaaaaaacctggtcgcaggtggcgtaattgaggccattcatcagcgcaccacctttaccggtatttttttgcgtgacggcaacaaagcggtcgccccatttgcgtttgacttccgccatgaccgcttcggtattgtccgtggagccgtcgtttacgcaaattacccggcaaaaataaggattacgcagcagattatccagtgactgtgccagacacgggccttcgttataagcaggtataatggcgtcaatacagcctttcttttgactgggtttacgttttagcgtacttaaaaaccatagcaacattgctatggacatacagataaatatccaggttttcatgcaatttgctcaaagaatcattttatgaattacaaagccttcacccagatcgctattgacctgttgcccgcgaaattgtgcaactgcacgcaggcgatcatgacgcatataatcgcgtcgttcctggcttttatgtttttttaatgcagcaagtttgactgtgaaatattcttctttaacggattcaaaaacctgaggcataaatgaaagccaggtgcttggggtttcgtagccgagaatttgtggaatagttcggcaggcaaccattgaagcttgataaacagcaagatgatcctgatggcggtcggcatcatgcatggtatatacccgcatgatttcaacatcagaaggaatttgatttttaatgatgtcttccagggcggaaatcatatcattgagctgcaaatgcgcgcgggtgtcagcaaaattaagatgaatagtttggtggcaccctaatatctttagggcgttgcgcgattcttcatggcgatcgattattccatctgtgccagagttgccggtagtcatcaccacggctgcgatataaattcctttttgcgcaagacgagcaagcgacgcgccacagcccaattctatatcgtcaggatgtgcgtcaatagcaaggataccctttcttttatttgccgaagaaaggatggctgaatctaaaaccttatccacttaatgacactccattttatttattatactacaagcacaacgatgcccgcagagacgtaatctctggcacagacagatgctaatttttaagtgttaaaaattactgatagctgaaaaataaggggctttcaggtacggggatacgactgcgtaatcttttatgtagttcatatgttaagtgtttgtgtgtttggtttgtatagttattttgttttatatattgtatttagatgtgatttagtttgtcaattaattacatattaaaaatatgttctaggcacaaatatggattatatacattatgtgaatgtattatgtggttgattgagaatgatacagttatatatgcaatgtgaatataatgatttcattatatgtattgctgttaataaaataaaagacattatgttctgcttgtttatgcattaataaaaatgaagtgcagtaacttactgaattgtcagcgtgggtgtaattgcatatttaatctttcctttgccgcttttttgctaagaataaaatcatctgtgcgataacgactaattcttttaatgaatgtttttattcctgaatactgctcctataacaagacaggggagcagacaatcatggcaatttcatcgcgtaacacacttcttgccgcactggcattcatcgcttttcaggcacaggcggtgaacgtcaccgtggcctatcaaacctccgctgaaccggcgaaagtggctcaggctgataacacctttgctaaagagagcggggcgacggtggactggcgtaagtttgacagcggagccagcatcgtgcgggcgctggcttcaggcgatgtccaaatcggtaacctcggttccagcccattagcggtggcagccagccaacaggtgccgattgaagtcttcttactggcgtcaaaactgggtaactccgaagcgctggtggtaaagaaaactatcagcaaaccggaagatctgattggcaaacgcatcgccgtaccgtttatctccaccacccattacagcctgctggcggcgctgaaacactggggtataaaacccggacaagtggagatagtgaacctgcagccacccgcgattatcgccgcatggcaacggggagacattgatggtgcttatgtctgggcaccggcggttaacgccctggaaaaagacggcaaggtgctgaccgattctgaacaggtcgggcagtggggcgcgccgacgctggatgtttgggtagtgcgcaaagattttgccgagaaacatcctgaggtcgtgaaagcgttcgctaaaagcgccatcgatgctcagcaaccgtacattgctaacccagacgcgtggctgaaacagccggaaaacatcagcaagctggcgcgtttaagcggcgtgccggaaggtgacgtgccggggctggtgaaggggaatacctatctgacgccgcagcaacaaacggcagaactgaccggaccggtgaacaaagcaattatcgacaccgcgcagtttttgaaagagcagggcaaagtccccgccgtggcgaatgattacagccagtacgttacctcgcgcttcgtacaataaaaggaggcgcggatgctgcaaatctctcatctctatgccgattatggcggcaaactggcgttggaagatatcaacctgacgctggaaagcggcgagctgctggtggtgctggggccgtctggctgcggcaaaaccaccttgctgaatctgattgccggttttgtgccttatcagcatggcagcattcaactggcgggtaagtgcattgagggaccgggagcagagcggggcgtggtttttcagaatgaagggctgttgccgtggcgtaatgtggtagacaacgtggcgttcggcctgcaactggcaggtgtagagaaagcactgcgcctggaaatcgcgcaccagatgctgaaaaaagtggggctggaaggcgcagaaaaacgctatatctggcagctttccggcggtcaacgtcagcgggtagggattgcccgcgcgctggcggcgaatccccagctgttattactcgacgaaccgtttggcgcgctggacgccttcacccgcgatcagatgcaaactctgctgctgaaactctggcaggagacaggtaagcaggtgctgttgattacccacgatatagaagaagcggtgtttatggcaaccgaactggttctgctttcacccggcccaggccgtgtgctggagcggctgccgctcaactttgctcgccgctttgttgcgggagagtcgagccgcagcatcaagtccgatccacaattcatcgccatgcgcgaatatgttttaagccgcgtatttgagcaacgggaggcgttctcatgagtgtgctcattaatgaaaaactgcattcgcggcggctgaaatggcgctggccgctctcgcgtcaggtgaccttaagcattggcacgttagcggttttactcactgtatggtggacggtggcggcgctgcaactgattagcccgctgtttttgccgccgccgcaacaagtactggcaaaactgctcaccattgccggaccgcagggatttatggacgccaccctgtggcagcatctggcagccagcctgacgcgcattgtgctggcgctacttgcggcggtgttgatcggcattccggttgggatcgccatggggctaagcccgacggtgcgcggcattctggatccgataattgaattgtatcgcccggtgccgccgctggcgtatttgccgctgatggtgatctggtttggtattggtgaaacctcgaagatcttactgatctatttagcgatttttgcacctgtggcgatgtcggcgctggcgggggtgaaaagcgcgcagcaggttcgcattcgtgccgcccagtcgctgggtgccagccgtgcgcaggtgctgtggtttgttattttgcccggtgcgctgccggaaattctcaccggattacgcattggtctgggtgtgggctggtctaccctggtggcggcggagctgattgccgcgacgcgcggtttgggttttatggtccagtcagcgggtgaatttctcgcgactgacgtggtgctggcggggatcgcggtgattgcgattatcgcctttcttttagaactgggtctgcgcgcgttacagcgccgcctcacgccctggcatggagaagtacaatgagtgaacgtctgagcattaccccgctggggccgtatattggcgcacaaattacgggtgccgacctgacgcgcccgttaagtgataaccagtttgaacagctttaccatgcggtactgcgtcatcaggtggtgtttctgcgtgaacaggccattacgccgcagcagcaacgcgcgctggcccagcgttttggcgagctgcatattcatcctgtttaccctcatgccgaaggggttgacgagattatcgtactggatactcataacgataatccgccagataacgacaactggcataccgatgtgacatttattgaaacgcctcctgctggggcgattctggcggcgaaagagttaccctcgactggcggcgatacgctatggaccagcggtattgcggcgtatgaggcactctctgttcccttccgccagctgttgagcgggctgcgtgcggagcatgatttccgtaaatcgttcccagaatacaaataccgcaaaacggaggaggagcatcaacgctggcgcgaggcggtcgcgaaaaatccgccgttactacatccggtggtgcgaacgcatccggtgagcggtaaacaggcgctgtttgtgaatgaaggctttactacgcgaattgttgatgtcagcgagaaagagagcgaagccttgttaagttttttgtttgcccatatcaccaaaccggagtttcaggtgcgctggcgctggcaaccaaatgatattgcgatttgggataaccgcgtgactcagcactatgccaatgcggattacctgccacagcggcggataatgcatcgggcgacaatccttggggataaaccgttttatcgggcggggtaagggggaaatgccgggttggataacccggcataatgatcattaacgcagaatcttcttctcagccaaatccagcgcaaagtagctgaaaatcagatccgcacccgcacgcttaatcgaacctaagctttcgagcacgactttctcttcatctatagcacccgccagcgcggcgaacttaatcatcgcatactcaccgctcacctgatacgcgccaatcggcaattcagtacgtccacgcagctcacgcacgatgtcgaggtacgctccagctggtttcaccatcaggcagtctgcgccctgggcttcatccagcaatgattcacgaatcgcctcacgacggttcattgggttcatctgatagcttttgcggtcgccttttaatgcgcttcctgccgcttcgcggaacgggccataaaaggaagaggcaaacttggtcgaatacgacataatcgccgtatctttaaagcccgcagcgtccagcgcctggcgaatcgcctgtacctgaccatccatcgcggcggaaggggcgatgaagtccgcacctgcagcagctgcaaccacggcttgcttgcctaaattttccagagtcgcgtcgttgtcgacgccatgctcgcacagcacaccgcagtgaccgtgagaagtgtattcacaaaagcaggtgtctgacatcacgatcatttcaggcacggtctgcttgcagatgcgcgacatccgcgccaccagtccatcttcccgccaggcatcgctgccggtttcatcggtatggtgagagatgccgaaagtcatcacggaacgaataccggcgttggcgatgcgttcaatttcgcgtgccagatgtttctcaggaatgcgcatcacgcctggcatggcttcaacggctttgtagtcgtcaatttcttcttcaacaaagatcggcaacaccaggtcgttaaggctaagtgttgtctcttcaaacatagcgcgcagcgcaggagatttgcgcaggcgacgagggcgttggattaagtctgtcatggtctgcctgatgtttgtggaatcgaggggcatagtatacctgaagcagggtggggatgttttacgaaagttgtcgcgatgttgacaagaagagaatgaaagagagtccatgacatctttgtaatagaaacagcaataatttcatattcactgaaaatatttttaatttttatttatatccctggattattgtttttacggatttgattgcgttatcaaaaacagaatgatttaaagttcattggttattgatagattatttgtctggtttgtgtgtttgatattttaaatgcatatgctttaaaaatggaactcctgttaacttgttgaaacatcaagcctttatcaattttttctttgtgtgttcctccgtgctttatatatgtccgtaaccggacttcggggaaagaataattgaaccattcctctataacgccgcataatcgtcaacgcgaaacataagatgttttctatgcattgataattgatggatcaacttattacgtccctgaggagggatgacaaatgcactcctggaaaaagaaacttgtagtatcacaattagcattggcttgcactctggctatcacctctcaggctaatgcaactacttatgacacctggacttattacgacaatcccgttactgcacttgattgggatcatatggataaggcaggcactgtagatggcaactatgtaaactatagtggttttgtctattacaacaacaccaatggtgatttcgatcagtcctttaacggcgataccgttaacggcacgatctcaacctattatttgaaccatgattatgcagacagtactgctaatcagcttgatatcagtaattcagtgattcacggttcgattacttctttgaagccaggcggttattatgatcgtttggatgcagatagtgatcttctggttggatatgatttttacactgatgcttttgttgacacaaactggcgtgatggtgatgttttcactcttaacattgctaacactaccattgatgatgattatgaagcgttttacttcactgattcttataaagatggtgatgtaaccaaacacacaaatgagacatttgataccagtgaaggtgttgctgttaatcttgatgtagaaagtaacatcaatatttcaaataactcccgcattgcaggtattgcattatctcaaggtaatacttacaacgaaacttatactaccgaatctcatacttgggataacaatatctctgtaaaagattccacagtgacttctggttcagacattattctggatagcgatacttatgtcaaaacaggacactttggcaactctagtgaaccgagtgattataccggtccgggagatgttgcaatgtccttcactgattcaggttccgactatgcaatgaagaacaacgtatacttcagcaattcaacgctgatgggcgatgttgcatttaacagcacttggaatagtaattttgatccgaatggtcatgattccaacggtgacgggctgaaagataccaacggtggttggactgatgatggcctcaacgttgatgaactgaacctcactcttgataacggaagcaagtgggttggtcaggcaatttataacgttgctgaaacgtcagcaatgtatgatgttgctacaaacagccttactcctaatgcaacatatgaaaacaatgactggaaacgtgttgttgatgacaaggtcttccagagcggtgtatttaacgtagcgttgaacaacggttctgaatgggatactacaggtcgttccatcgttgataccttgacagttaataatgcttctcaggttaatgtttcggaatctaaattaacttcagatactatcgatttaactaacggttcttcgctgaacattggtgaagatggttacgttgataccgatcatctgactattaactcctacagtactgttgcgttgaccgaatctacaggttggggtgctgattacaacctgtacgccaataccatcaccgtaactaacggtggtgtattggatgtgaacgttgatcagttcgatactgaagctttccgtactgacaaactggaactgaccagcggcaacattgctgacaataacggcaacgtagtgtctggtgtattcgatatccacagcagcgattacgttctgaacgcggatttggtgaacgaccgtacctgggacactgctcaggctaactacggctacggtattgttgctatgaactctgatggtcacctgactatcaatggtaacggcgacatcaacaacggcgacgaactggataacagttctgtagacaacgttgttgctgcaaccggtaactacaaagttcgtatcgacaacgcaactggcgctggcgcaatcgctgattacaaagataaagaaattatctacgtaaacgacgtcaacaccaacgcaaccttctctgctgctaacaaagctgacttgggtgcatacacctatcaggctgaacagcgcggtaacaccgttgttctgcaacagatggagctgaccgactacgctaacatggcgctgagcatcccgtctgcgaacaccaatatctggaacctggaacaagacaccgttggcactcgtctgaccaactctcgtcatggcctggctgataacggcggcgcatgggtaagctacttcggtggtaacttcaacggcgacaacggcaccatcaactatgatcaggatgttaacggcatcatggtcggtgtggataccaaaattgacggtaacaacgctaagtggatcgtcggtgcggctgcaggcttcgctaaaggtgacatgaatgaccgttctggtcaggtggatcaagacagccagactgcctacatctactcttctgctcacttcgcgaacaacgtctttgttgatggtagcttgagctactctcacttcaacaacgacctgtctgcaaccatgagcaacggtacttacgttgacggtagcaccaactccgacgcttggggcttcggtttgaaagccggttacgacttcaaactgggtgatgctggttacgtgactccttacggcagcgtttctggtctgttccagtctggtgatgactaccagctgagcaacgacatgaaagttgacggtcagtcttacgacagcatgcgttatgaactgggtgtagatgcaggttataccttcacctacagcgaagaccaggctctgactccgtacttcaaactggcttacgtctacgacgactctaacaacgataacgatgtgaacggtgattccatcgataacggtactgaagggtctgcggtacgtgttggtctgggtactcagttcagcttcaccaagaacttcagcgcctataccgatgctaactacctcggtggtggtgacgtagatcaagactggtccgcgaacgtgggtgttaaatatacctggtaatattcttcactctgaagaaataggttatttaatctaaataatgcccgtcaaggatttgacgggcattactgcaaaggacgcgcaaatgttatctgtagttaaacctcttcaggaatttggtaagctcgataaatgtttgtccagatatggcacgcgcttcgagtttaataatgaaaagcaagttatattttcaagtgatgtcaatagcgaagatactttcgttattttagagggcgttatctctctgcgtagagaagaaaacgttcttatcggtattacccaggctccttatattatgggactggctgatggtttaatgaaaaacgatataccatacaaattaatatcagaaggaaattgtacgggatatcatctaccagccaaacaaaccattacccttattgaacaaaatcaactctggcgagacgctttttattggttagcctggcaaaatagaattctggaattacgtgacgtacagctcattgggcataattcctacgaacaaatccgcgcaacgttattatcaatgattgactggaatgaagaattacgctcacgtattggtgtgatgaattacatccatcaacgtacacgcatatcgcgttctgtcgtcgcagaagttctcgctgctttacgtaaaggcggctatatcgaaatgaataaaggcaaactggtcgctatcaaccgtttgccttcagagtattaatcaggatgcggggatgaccaacggtttattcccgctcagttcggtcaccaggtcattgatgccatcgctcatatttttaaagcgcgtcaatggcgaacgagtgaccaccacaaatgcgccaatgttcttctgcgggatcatcgccatataggtaatgaaaccgccaccaccacctgtcttctgaataatccctggacgaccctctttcggggccatatatacccagcctaaaccaagcgcgtccgctttgccggggacatccatgccaatcactttcgtaaactgcgcgcgctgataaatcaacgtctgcatgcgatctgcctggttactgcgctgataaaaatcagatgacaaatactgctgcatccagcgcatcatatcgccaggcgtggaatagactccgccgctgccaattgccgccagcgtgttattgcacggactggcaccacgctcagcaaccattaaacggcggcactggtccggcgagggggtgtaggtggtgtctttcatccccaatgggcgggtaatctgctcttcaaacaactgggtataaggcttgccggacgcattcgccagtgcatctgccagcaggtcgaacgcaaggttggagtacgcggcctggctgcccggcgcggcttttagtttggcagtggaaaggtatttccagcgttgctcgcgcgttggccagacaaataccggacgatgtgccgcgccaccgggctgttcacggggcagggcgctggtatgggttgccagattcactagcgtaatgggcgtcccattgtaggtcggtacgcgtgcgcctggcggagcatatttacttagcggatcgtttaacttcacggtcccctgatcgagcaatttcaccagcatctcactggtcattaacttggtgagggaagcaatacgtatgaccgaatccagctgcgggcgaacgttattaccaggtcgcgtttcgccataactacgaaagacgcgctggttaccgtcgataactaccagcgccatccccgtggcaccgctgccgtaaaaaatataatcggcataacgatcgacaatatcagaggcaaactccggttcagtgatcggctgcgccgcatggacggaggtcaatgacgccgcacacagcacggcagaaaaaagcagactacgtttcaacggtggtgtccatagattgaatgaaggtaactgagcgtatttatactactcattgatggattgcaaagggcgaattagtgcaataatagtgttaaaaacgtaacggcgcgtaaacacgatctttttcctgctcaccaatgcctgcatttgtgatcctgcgcgtgttaatccgcttatgtaaacaatctttggtttgtgaaatccgtcgaaacaattcttatgctcaggctggcgaactaagcgccttgctatgggtcacaatgggcggtttcatttggctgactctttgtagcggtcatgcggttaatacacagcagttgttaaaacgataagaagttagcaggagtgcatatgtttaagtcttttttcccaaagccgggaacgttttttctctcggcctttgtttgggcattgattgccgttatcttctggcaagcaggtgggggtgactgggtggcgcgtatcaccggagcttccgggcaaatcccgattagcgccgcgcgtttctggtcgttggattttctgattttttacgcttactacattgtttgtgtaggactttttgcattgttctggtttatctacagcccgcatcgttggcaatactggtcaatactcggtactgcactgatcatcttcgtcacctggtttttggtggaagtcggggtcgccgtcaacgcctggtatgcgccgttctatgatctgattcaaaccgcgctaagttcgccgcataaagtcaccatcgaacaattttaccgcgaagtgggcgtctttctggggattgcgctgatcgcggtggtgatcagtgtgctgaacaacttctttgtcagtcactacgtgttccgctggcgtacagcgatgaacgaatattacatggcgaactggcaacaactgcgtcatatcgaaggtgccgcacagcgtgtgcaggaagacaccatgcgttttgcttcaacgctggagaatatgggcgtcagctttatcaacgctatcatgacgttgatcgccttcctgccggtgctggtaacgctctccgcgcatgtgccggagctgccgattgtcgggcacattccgtatggcctggtgattgccgctatcgtctggtcgctgatggggaccggattgctggcagtggtagggatcaaactgccggggctggagtttaaaaaccagcgtgtagaggctgcctaccgtaaagagctggtttatggtgaagacgatgccacgcgcgcgacgccgcctacggtacgcgagctgtttagcgccgtacggaaaaactatttccgcctctattttcactatatgtatttcaacatcgcccgcattctctatttgcaggtcgataacgttttcggtttgttcttgctgtttccgtcaattgttgccggtacgattacgctcggcctgatgacgcagattaccaacgtttttggtcaggttcgcggagctttccagtacctgattaactcatggaccacactggttgagttgatgtctatctacaaacgtctgcgcagctttgaacatgagctggatggtgacaaaattcaggaagtaacccataccttgagctaaaaaggagaagtaatgtcgcgcgtcaatcatctatcttcgctgtcattgttggcggttctggttttagcggggtgtagtagtcaggctccgcaaccgttgaaaaagggcgaaaaagcgatagatgtggcgagcgtcgtgcggcagaagatgcctgcgagcgtgaaagaccgcgatgcctgggcgaaagatctcgccaccacgtttgaaagtcaggggctggcaccgacgctggaaaacgtctgctcggtgctggcggtggcgcagcaggagtcaaattatcaggcagatccggccgttccgggcttaagcaagatcgcctggcaagagattgaccgtcgtgctgaacggatgcacattcctgcttttctggtgcataccgcgctaaaaatcaaatcgccaaacggcaaaagctatagcgagcggttagattcggtgcgtacagaaaagcaattgagcgcgatttttgacgatctgatcagcatggtgccaatggggcagacgttgtttggttcgcttaatccggtgcgcaccggtgggccgatgcaggtcagcattgcttttgccgaacagcataccaaagggtatccgtggaaaatggacggtacagtccgtcaggaagtcttcagtcgtcgcggcgggttgtggtttggtacttaccatttactgaattatcccgccagctatagcgcgccgatataccgttttgctgattttaacgctggctggtacgccagccgtaatgccgcgtttcagaacgcggtcagtaaggccagcggcgtgaagctggcactggacggtgatttaattcgttacgacagtaaagagcccgggaaaaccgaactggcaacgcgcaaactggcgggaaaactggggatgagcgacagtgaaattcgccgccagttagagaaaggcgacagcttctcttttgaggagacggcgctgtacaagaaagtttatcaacttgccgaagcgaaaacggggaaatcactaccccgcgaaatgttgcctggcattcaactggaaagcccgaaaatcacccgcaacctgactacggcctggtttgcgaagcgcgtagacgaacggcgggcgcgttgtatgaaacagtgatcaaacaggaatgtcatgccagataaggcgttttaggccctatctggcaagtaaatcttactggcgacgatgtcgccagtgcagccatagcgccactactgcaaaaatgaggcagcctactaaaaacgggatcagcccgaaaatggtgccgacacctaaaccaatttccacccgtgggcgacctgtttcctggacctgcattaaacgctcatagacgccgggcgcatgcactaacaggttcagcaattgcgccccagcccaaaagcaaaacagcacaaacaacgcataggcaatattgccaggcgttgaagaggcattgcgatattttccgctaaacagcgattttgacagggtgaaatcagccataaaaacctccggaagtcatctgcttctcttctggtgtgataccagcggcttatggcaagtctgacaggacatttagattgtcaatatcagaatcatggtaaattgatgttgggaatattcccgaagcgtgaatcttcgtcgtgagtcacaaaatgataaccttaagttaaatttattaacaattacggaagtgttgtctacgccacagacggttgttgcagaatatgcaaggatgttgtttttcgttaacggagctgccatgaacttgcctgtaaaaatccgccgtgactggcactactatgcgttcgccattggccttatattcattcttaatggcgtggtgggtttactgggatttgaagcaaaaggttggcagacctatgccgtcggtctggtgacgtgggtgattagtttctggctggcggggctgattattcgtcgtcgcgatgaagaaactgaaaacgcccaataacagaggattgggcgttctgggagctgacaaagtgctcgttgtttttgccggatgcggcgcgaacgccttaccctgcctacaaaatcatgcaaaatcagtatattgcaattatctggtaggcctgataagcaaagcgcatcaggcaatcttactttttccatcagtcttaaatgcccaataaaagttatcaggcatttaaaaattacattgtggttttcaatgcgttatccgcagcgtgacgctccagcgccagttcaatcaaacgggtgatcaggtcggtgtaacccagaccgctggcttgccacagcttcggatacatactgatgttggtgaagccaggcagtgtgttgatctcgttgatcaccacttcgttctctggggttaaaaacacgtctacacgcgccatgcctgcgcatcccaacgtctgataagcctgaacggcaatcgcccggatcttatcgttgatttctggcgcaatggctgccggaactaccactttcgcgccatcttcatcaatgtacttggtgtcgtaggcatagaaatcgctggtgagtacgatctcgccacaggtgctggcttgcggattgtcgttgcccagaactgcgcattcgatctcacgacctttgatcccttgctcaacgatcactttatggtcgaactcgaacgccagatcgacggcaattgcgtactgttcttcactggttactttgctgacaccaacagaagagccctgattagccggttttacaaacagcggtaaccccagtttagactccacttcggcaaaactgatgttgtgacgattagcgcgcgtcagggtaataaatggcgcaatgttcagcccggcatcgcgcagcagacgtttggtgacatctttatccatacaggccgctgaagccagaacatcagaacctacaaacggtaaattggcgacccgcagcattccctgcaaagaaccatcttcgcccagcgtaccgtggacaatcgggaaaatgacatccaccgtcggcaacggctgaccgttttgcgtgtcgataagctgatgttcatgtttaccaggcacctgcgcaagactggtcgccgaagggcgcaatgcaatatgggcaggatcgtctgcatttagcagataattgctggcatcgctgacgtgccattgcccttgtttatcaatgcccagcagcacaacgtcgaagcgacttttatcaatggcatcgacaatgttttttgccgattgcagagacacttcatgttccgctgatttaccaccaaaaacgattcctacccgcagtttttccatcttaaaaacctatcccgtctaacacaaagtgcatacattaccacgacaaaacgggggattcgcggccttctgacagaatgttgcaatcttctgctgacaaagcgtgcaacgtactggtgaagaaagtgcgttatctcaatgatgtgcgcaagatcacaaaaatgatgaacgggaagctaatttattcctggcttgtatggccatgcagtgagttttttctcttaattataagttaacgaagagaatatatttcataacttttatttataataaaggttgataattaaaagcctatattttgtgtgggtaattattaaaataagagaaacgtttcgctggtaatcaaacaaaaaatatttgcgcaaagtatttcctttgtcataaaaataatacttccagacactatgaagttgtgaaacataatgttaacttctccatactttggataaggaaatacagacatgaaaaatctcattgctgagttgttatttaagcttgcccaaaaagaagaagagtcgaaagaactgtgcgcgcaggtagaagctttggagattatcgtcactgcaatgcttcgcaatatggcgcaaaatgaccaacaaaggttgattgatcaggtagagggggcgctgtacgaggtaaagcccgatgccagcattcctgacgacgatacggagctgctgcgcaattatgtaaagaagttattgaagcatcctcgtcagtaaaaagttaatcttttcaacagctgtcataaagctgtcacggccgagacttatagtcgctttgtttttatttttaatgtatttgtacatggagaaaataaagtgaaacaaagcactattgcactggcactcttaccgttactgttttcccctgtgacaaaagcccggacaccagaaatgcctgttctggaaaaccgggctgctcagggcgatattactgcacccggcggtgctcgccgcttaacgggtgatcagaccgctgctctgcgtgattctcttagcgataaacctgcaaaaaatattattttgctgattggcgatgggatgggggactcggaaattactgctgcacgcaattatgccgaaggtgcgggcggcttttttaaaggtatcgatgccttaccgcttaccggacaatacacacactatgcgctgaataaaaaaaccggcaaaccggactacgttaccgactcggctgcatcagcaaccgcctggtcaaccggtgtcaaaacctataacggtgcgctgggcgtcgatattcacgaaaaagatcacccaacgattctggaaatggcaaaagccgcaggtctggcgaccggtaacgtttctaccgcagagttgcaggatgccacgcccgccgcgctggtggcgcatgtgacctcgcgcaaatgctacggtccgagcgcgaccagtgaaaaatgtccgggtaacgctctggaaaaaggcgggaaaggatcgattaccgaacagctgcttaacgctcgtgccgatgttacgcttggcggcggcgcaaaaacctttgctgaaacggcaaccgtcggcgaatggcagggaaaaacgctgcgtgaacaggcacaggcgcgtggttatcagttggtgagtgatgctgcctcgctaaatgcggtgacggaagcgaaccagcaaaaacccctgctaggactgtttgctgacggcaatatgccagtgcgctggctaggaccgaaagcaacgtaccacggcaatatcgacaagcccgcagttacctgtacgcctaatccgcaacgtaatgacagcgtaccgaccctggcgcagatgaccgacaaagccattgaattgttgagtaaaaatgagaaaggttttttcctgcaagttgaaggtgcatcaatcgataaacaggatcacgctgcgaatccttgtgggcaaattggcgagacggtcgatctcgatgaagccgtacaacgtgcgctggaattcgctaaaaaggatggcaacacgctggtcatagtcaccgctgatcacgcccacgccagccagattgttgcgccggacaccaaagcgccgggcctcacccaggcgctaaataccaaagatggcgcagtgatggtgatgagttacgggaactctgaagaggattcacaagaacataccggtagtcagctgcgtattgctgcgtatggcccacatgccgccaatgtcgttggactgaccgaccagaccgatctcttctacaccatgaaagccgccctggggctgaaataaaaccgcgcccggcagtgaattttcgctgtcgggtggtttttttgctgttagcaaccagacttaatggcagatcacgggcgcatatgctcatggttaaaacatgaagagggatggtgctatgaaaataacattactggttaccttgcttttcggtctggtttttttaaccaccgtcggcgctgccgagagaaccttaaccccgcaacaacagcgtatgacctcctgtaatcagcaggcgacggcgcaggcgttgaaaggggatgctcgtaagacctacatgagtgattgcctgaagaacagcaagtctgcgcctggtgaaaaaagtttgacgccacagcagcaaaagatgcgcgaatgtaataatcaagcaacgcaacaatctctgaaaggtgatgatcgtaataagtttatgagcgcctgcctcaagaaagccgcctgatacctgatagtgctaacgggtgagctacgaaaatggctcacccgaaatttcatacttctgcctttagccccgtctctataatttgggaaaattgtttctgaatgttcccaaaaataatgaatgatgaaaactttttcaaaaaagcggcggcgcatggggaggaacctcctttaactcctcaaaacgaacatcagcggtccgggctgcgcttcgcccgtcgcgtcagactaccccgcgcggttggcctggctggtatgttcttaccgattgcttcaacgctggtttcgcacccgccgccgggctggtggtggctggtgttggtcggctgggcgttcgtctggccgcatttagcctggcagatagcgagcagggccgtcgatccgcttagccgggaaatttacaacttaaaaaccgatgcagtattagcgggaatgtgggtaggcgtaatgggcgtaaacgtgctgccttccaccgcgatgttgatgattatgtgtctgaatttgatgggggcaggcggcccccgtctgtttgtcgcgggtctggtgttgatggtggtttcctgtcttgtcacccttgaactgacgggcatcaccgtgtcgttcaatagtgcgccgctggaatggtggctctcccttcccattatcgtcatttatcctctgctgtttggctgggtcagctaccagacggcgactaaactggcggaacataaacgcaggttgcaggtcatgagtacccgcgacggtatgacgggcgtgtataaccgacgtcattgggaaactatgttacgcaatgaatttgataactgtcggcggcataaccgcgatgcgacattactgattatcgatatcgaccatttcaagagcatcaacgatacctggggccatgatgtgggcgatgaagcgattgtggcgcttacccgacaattacaaataaccctgcgcggtagcgatgtgattggtcggtttggcggcgatgagtttgcggtaatcatgtccggtacgccagctgagagcgccattaccgccatgttacgagtgcatgaagggctaaatacattacgtctgccgaatacgccacaggtaactttacggattagtgtgggggttgcgccgctgaacccacaaatgagtcactatcgtgagtggttgaaatcggcagatttggcgctttacaaagcaaagaaagccggacgtaaccgcaccgaagtggcggcctgacgtccggcaaaagtcatcaggatttactgagtttttctgatttttccatacacttcgtcatcgcttcgatcactgcggcacggaagcctttctcttccagtacgcgtaccgcctcaatggtggtgcctcccggtgagcagaccatatctttcagtgcccccggatgttctcccgtttccagcaccatttttgcggaacccattaccgcctgagcggcaaatttatacgcctgggcgcgtggcatcccgcccagcacggcagcgtcggccatcgcttcgataaacataaagacgtaggctggcgaagaaccgctcacaccgaccaccgggtggatcatcggctcggcaattacttccgcttcgccaaagcagcggaaaatattcagcacatcagcggtatcttctggggttaccagcgcgtttggcgttacggaggtcatcccggcattaaccagcgcgggagtgttcggcatggcgcggataattttccggtcatggcccagcgcgcgggcaagctggtcgagtgtgatacctgcagcaatagaaacgaccagagagtctttattcaggctggaggtgatttcgctaagcactttaatcatgatgccaggtttaacggcggcaaaaatgatgtcggcgatttgcgccacttcttgcgccgattctgcggcgttgatgccgaactggtcatgcagggcggcgactttatccggggagggggtatatacccagatttgccctggaagcacctgaccgctggcaatcagaccgccgagaatggcttttcccatattgccgcagccaataaaaccgattttcttttccattgcctcactcctgccgtgaaattcattgttttgataatcgctggcagaagcataaacagaactatgccggaaggcaaaagcgcgacacaatagaggattacccaacaaaggatgactttatgacaatttgggtggatgccgacgcgtgtcccaatgtaattaaagagattttgtatcgcgcggctgaacgtatgcagttgccgctggtactggtagcaaaccagagtttacgcgtgccgccatcgcgatttattcgtacgctgcgcgtcgcggcaggtttcgacgttgccgataacgaaattgtccggcagtgtgaagcgggcgatttggtgatcaccgcagatattcctttggctgctgaagccatcgagaaaggcgcggcggcgcttaatccacgcggcgaacgttacactccagcgaccattcgtgagcgtctgacgatgcgcgattttatggataccttacgcgccagtgggatccagaccgggggaccagatagtctttcacaacgtgaccgccaggcctttgccgcggagctggagaagtggtggctggaagtgcaacgtagtcgtggctgaatgtaatttattatttacacttcattcttgaatatttattggtatagtaagggatgtattaaaattttcactttaagtggaattttttctttacaatcgaaattgtactagtttgatggtatgatcgctattctcatgacaccggctttcgccgcattgcgacctattggggaaaacccacgatgacacaacctctttttctgatcgggcctcggggctgtggtaaaacaacggtcggaatggcccttgccgattcgcttaaccgtcgatttgtcgataccgaccagtggttgcaatcacagctcaatatgacggtcgcggagatcgtcgaaagggaagagtgggcgggattccgcgccagagaaacggcggcgctggaagcggtaactgcgccatccaccgttatcgctacgggcggcggcattattctgacggaatttaatcgtcactttatgcaaaataacgggatcgtggtttatttgtgtgcgccagtatcagtcctggttaaccgactgcaagctgcaccggaagaagatttacggccaaccttaacggggaaaccgctgagcgaagaagttcaggaagtgctggaagaacgcgatgcgctatatcgcgaagttgcgcatattatcatcgacgcaacaaacgaacccagccaggtgatttctgaaattcgcagtgccctggcacagacgatcaattgttgattttcgagcgcctatacttaacgttcatcccgtgaaataaggaagaacgatgccaacgaaaccgccttatcctcgtgaagcatatatagtgacgattgaaaaaggaaaaccaggacagacggtaacctggtaccaactcagagccgatcatcctaaaccagactcgttgatcagtgaacatccgaccgctcaggaagcgatggatgcgaaaaaacgctatgaggaccctgacaaagagtgaccgcatcagactgctcggaagggattctgagtgccaccacaagggatctgcgtcacatttttcacaattcatgtttttcaaataattagaatattagacaataacaatccattactggaatcatttggaatctttacattatgccgtgcaggtctgctgctacgctttttgtcatttgtagcacaggtaagtgtcagcagtggtgcttagcgcttgcccggtaattaacgacgaaataaaagtaaggtggaagaacaatgagtgcgtcgttggcgatcctgaccatcggcattgtacctatgcaggaagttttgccgctcctgacagaatacattgacgaagataatatttcccatcatagcctgctggggaagttaagtcgtgaagaagtgatggcggagtacgcgccagaagcaggcgaagacaccattctcacattattaaatgacaaccagctggcccatgtttcgcgtcgtaaagtggaacgagacctgcaaggtgtggttgaagtgctcgataatcagggttatgacgtcattttattaatgagtacagcaaacattagtagtatgactgcgcgtaatacgatctttcttgagccgtcgcggatattgccaccgctggtttcctctattgttgaagatcatcaggtgggggttatcgtaccggttgaggagttgctgaccgttcaggcgcaaaaatggcaaattttgcagaaaccgccagtattttcattgggtaaccccattcatgattcagaacaaaaaatcattgatgccgggaaagaattactggcaaaaggggcagatgtcatcatgctggattgtttgggatttaaccagcgtcatcgcgatttactgcaaaaacagctcgatgttcctgtcttgctctctaacgtattgattgcacggctggctgcggaattactggtgtaattttgcgtgacagccagcgcctctggcccctatagtgaagtagatgttcaactaccagacagggccagtttatgcttcaaagtaatgagtacttttccggcaaagtgaaatcgatcggcttttccagcagcagcactggtcgcgccagcgtgggtgttatggttgaaggcgaatacaccttcagcaccgctgagccggaagagatgacggtaatcagtggcgcgctgaatgtgttactgcctgacgcgaccgactggcaagtgtatgaagccggttcggtgtttaatgttcccggtcacagtgagtttcatctgcaagttgccgaacccacctcttatctgtgccgctatctgtaattcctcgccttccccttgaacgggagggcatttttctgaaatgttctctcataaacccataataatatttcctttgctgcgattttttcgatttccgatatattcataattcatcaaggttgatataaatatcagcgaagatctccagatattgttgcggaactggcgacgataaaagataaatcagatgatgaatggtggcgtgcattgctgcaaagtcgcaatgatcatttgcgccaaacggcattgcgcaacgcacataccccggcgtcgttgttaacggcattgactgagcctcaggatcgggcgttggttattaataatccacagttggctgccgatgtgaaaacgatgtggttaaaagatgatccatcattactcttatttgtcgatcaacccgctctttcgcagttacgggatttagtgaaaaccggggcaacgcggaaaattcgcagtgaagcgcgtcaccggcttgaggaaaaacaatgacacaacgcccatggagcaagttacagcgtaaaacgcataatattgctgcgctaaaaattattgcccgccgtagcgaataattatatgcctggtgtggcttcgtacgccggataagacgcggcaggcgtcgcatccggcattaaaggtaaatcagcaattaacgttgtgcttcgccacctaatccttcaatcaggttttgaattaacgctgccagttcaccagtcatcaggatgaaatcggcatcaaaacgctgggcgaaatcttcacggtcgatatcttcgttttgatcgcgcagctcgtcgcagaacttcagacgcttgagcgaaccatcgtcgcacatcacaaactgaatgcgctgctgccagtcgagcgccagtttagtcaccacttttccggcttcaatgtgattggtgatctcttcgctggtcagatcttgtttcttcgcgcggatcactccaccatcttccagcagcgatttcagctcggcttcatcaagcagctggaagccctgtgccgcgctgccggagcgtacccattcggtcagcgtcagttcaatcgggttttccatgctcaatggtacaaccggtaacgaccccaggcttttacgcagtaatgccagcgtatcttccgcttttttggcactggcgcagtccaccataatcaaaccgttaaccgtgtcgatccacatcattgtctggctaaaacggctgaaagcacgtggcagcagagagtgcagcacttcgtctttcagcgaatctttttcggttttcttcagcttacgcgcctgttccgcttccagtttggcgattttcgcttccagcgcctgtttaatcaccggagacgggaggattttttcttctttgcgcgcgcagataacaatttgaccattggcaacgtgcgttaacgcatcgctgtgcgatcccatcggaggaacccagcccatcttcgccatgtcctggctgccgcatggggtaaatgccatcgaggctagctgtttttccatctcttctgcacgcagcgaaatctcgcggctaagacggtaaaccattaaatttttgaaccacagcatgataatttccacggccttgtcgttaaatttagcgggcatgataacgaattgtcggcggccttgcattgccaatccggttgtccgtctctacgctattgatattgaaaaaaataaggagagtaccgtgcgtataggtatcgatttaggcggcaccaaaactgaagtgattgcactgggcgatgcaggggagcagttgtaccgccatcgtctgcccacgccgcgtgatgattaccgccagaccattgaaacgatcgccacgctggttgatatggcggagcaggcgacagggcagcgcggaacagtagggatgggcattcctggctcaatttcgccttacaccggcgtggtgaagaatgccaattcaacctggctcaacggtcagccattcgataaagacttaagcgcgcggttgcagcgggaagtgcggctggcaaatgacgccaactgtctggcggtttcagaagcagtagatggcgcggcagcgggagcgcagacggtatttgccgtgattatcggcacgggatgcggcgcgggcgtggcattcaatgggcgggcgcatatcggcggcaatggcacggcaggtgagtggggacacaatccgctaccgtggatggacgaagacgaactgcgttatcgcgaggaagtcccttgttattgcggtaaacaaggttgtattgaaacctttatttcgggcacgggattcgcgacggattatcgtcgtttgagcggacatgcgctgaaaggcagtgaaattatccgcctggttgaagaaagcgatccggtagcggaactggcattgcgtcgctacgagctgcggctggcaaaatcgctggcacatgtcgtgaatattctcgatccggatgtgattgtcctggggggcgggatgagcaatgtagaccgtttatatcaaacggttccgcagttgattaaacaatttgtcttcggcggcgaatgtgaaacgccggtgcgtaaggcgaagcacggtgattccagcggcgtacgcggcgctgcatggttatggccacaagagtaaaaaacgtaggcaattggctcatcatgcctgatgcgacgcttgccgcgtcttatcaggcctgcaaaatgtgccagaaccgcgtagggcggataaggcgttcacgccgcatccggcaataagcaacgtgctccgtgactgcaatctaccccactggtttcgccagcaccggactatccgccgcttgctggcgcttatagcgaccatacagcagcaacgacgacatcgcagcaaacgaaagcagggcggcaggtagcgccacgtaattatatgccagccccagcgtcagcatcataccaccgcaatatgcgccgacggcgctaccgaggttaaacgctatttgcccacctgcggcacctaataactctccgcctttggcattttgcagtaacaatatttgcagtggtgctgaaagggcaaataatcccgcgcaacaaaaaaatgcaaaaataagcgacgttgttttcatgccgccgaagaaaaagagcatcagcagtgccagcacaataataaagtcagttactgccgcaatgcgcagtggtgaataacgtcctgaaatccggccacttagcacattccccagcaccatccctagcccaactaacatcataataaaagtcatcgccgtttccgaaaaaccggaaataaacatcatgtatggctttacgtagctgaaccaggcaaatacacctgcgttgccaaacatggtggcggcgaaaattaaccacggggccgggctgcgcaaaaagtgaaattgttcgcgtagcttccctttcgcctcgtcgcgaatatccggcacccaaaaatagaccgatgccatcaccgcaatattaaaaacagcgatcaataaaaaggtgtaacgccagctaaattcctgacttaaatacgttcccagcggaatgcccagcaaattggcgactgtcatcccggaaaccatccccgccacggcggcggtgactttgccgggtttgataattttcgataacacgatcgcgccgacgccaaaaaatgcaccatgcggaaagccggaaaccagccgaccaatggcgagcatcaggtaagacgaagagagcgtgaacatggcgttgccaatgacgcacaacgccaccagaaacaataagatatgtttgagtgagtagcggctggaaaagagtgcgatgattggcgcaccgaccaccacccccagcgcataatacgagatcatatgcccggcagcaggaattgaaattcctacgttatgcgccagctccgtgagcacgcccataatgccaaattcggccatccccaaaccaaacgtgcccagagccaaagataaaataacttttttcataccaccatcacaaccaccagaacggctactaatcaccgtagccaataaagtgatagcttgcaggataacgaccagcgaggccaagagataattcgcccctctgtattcattatcctgctgaatagttatttcactgcaaacacactttccagtttgctgtagcccagtccattgatcttcttcactttgatctgcaccggaatacgctctttcatcgcttcaacgtggctaatcacaccgatggttttgccgctggcattcagggcatccagcgcatcaagggcggtatccagcgtttcactatccagtgtgccaaaaccttcatcaaggaacagcgagtcaatacgcgttttatggctgaccagatccgaaagcgccagcgccagcgccagactgacgaggaaactttcgccgccagaaagggtacgggtgtcgcgtaccgcatctgcctgccaggtatcaacaacctcgacttccagcgcctcgctggctttgcgctgtaacagatagcgcccgtgcagccgggtaagttgctgattagcgagatggactaaattatccagcgtcagcccctgggcaaacttgcggaatttatcgccctctttggaacctattagcgaattcagatatccccagtcctcaacctgctgcgtcatttgagcaatttgctgcagtaaggtttgttgttgctgacggttatctgcatcctgcttcagctgctggcgaatctcgccctgactggtggtgttttcacgcaacttttgctgagtttgcgctaactcttgctgaatctgctccaccgttacagtgagagccaacccgccaggtcggtgttgctgatgctgtgtcagcgtttctgctgtctgaatggccaacgcttgcgcctgacgacgctggttttccagattctgtttcagctgttccagctgcgttagcgtctgctcatccattaacgccgcaagaaatgcctgctgatcgtcaaaaatgctgtcctgtagcgcggtgtcaaactgcgcctgggctttttgcagactttgcgctgccagagcctcctgttgctgcaacgtttgctgctggctttgcaacgcgaggcattgttcgtgaacttgccgccagttttccagcgctacagtttcttcgctgtgcgggagttcatcactttgcggcaacgtttccagaatcggcgtcagttgctgaatacagttttgcagcgcggttaattcgttctggcgatgctgccagctctgcgcttcttgctgacgcgtcgccaaccagctctcttcttcatcttcctgtggcaatgtcagcgcataacccgccaatgccgttaagagctgctgctggcgttgttcaatttgctgttgatactggataatttgctgattatgcgcggcaatctgcccttgtaattcatgccgttggctgagtaaccgcagctggcgttcgtgctcatcttgtgcatccagccacggttgaatatcgtcctgtggctgcaaggtgatattgaggctggccgtgacggcttgccattgttgagtaagtgcttgctcatcttgtcggaggctttgcgcttcgttttcatcacgctgaagttgctttgttaaggcgtccagttgcccacgtagcgtcgcaccttcttcaccgagctttttaacttcgttttccagcgccagtaatcgagactgattaacgccaggctccagcgcctgatacgcctcgaccgccgggtggctggtggaaccacaaagtggacaaggctgacccgcctgtaactgtgcacgttgagcttccagcgttttgatgcgcgcttcctgctcgcaaatggttttcacatcggcaagttgctgcgtcttttctttataacgctggcgcatttcgttaagtgcggcgttacgttgcgtctgttcttgcgtgacattctggatagtgacctgtaattgcgccaggcgtttttgttggggaacaatctgtccatgcagcgcgaccaggcgctgacgcagtgggcgttgctcagcatgttgcgccagggcgctagcaacttcatcggcggttaacgtcaacgtgatcgccgcaagcgcattaagtttttgctctgcatgggttaactgttgctgccattgccgcagatgctcgcgatcgctggtttgttgggagaactgcgcacgccaacccgccagttcgttgttccactgacggaagcggtcgtgttcctgtaaccaggtattcaggctttgttgctgctgctgtaattctgctgactgcttcgccgcgtggtggcgaatgctcgcgcgaagcgccattgtgctctgtaagcgagtatttacttcttcaatctgctggcgagtatgcgccagcgccgcgctgtgttctgcgatgcgttcccagtgcggacgaagatttcgtgccggttgtgccagactgagcgccgccagttgaggttgcgctttttcttcttcggctaacgcctgttgcaaggcctgttgacggcggctggcttcttgctgcaattcgtccagacgcgttaaccagtttagtgattgttgttcttgctgctgcgcggtaagtaactgtttttcttcgtcagtaagtacctgcaaactcgctgtcagcgattgcacttgttctggcgtgagcaacgcgacgccgctggcctgcgcttgcagcttctccagctctgtgcgggccgatttgtgctgctcaaaaaccatcgccgagatttgcccgtagatttcagtgccggttaactcctcgagcaattccgcgcgttctttgggtttggcattcaggaaggcagcaaattgcccctgcgaaagcagcatcgaacgggtgaagcgcccgtaatccagtccggttaacgtcgccgtcagttccagcttatctttcactttgtcggcgagaattttgccatcggcacagcgcgccagctcaacgcgtggcacctgcaaattaccgtccggctggttacgcgcccgattctggctccagaatgcacggtacgcttcacctttgacttcaaactccacttccgccagacattcggcggtatcgcgggtcatgagatcattttgcgattgtgaaacgttagaaaggcgcggagtttcgtgatacagcgccagacaaatggcgtccagcagggtggttttccccgcaccggttgggccggtaatggcaaacagcccgttgctggcgaacggctcgcgggtgaaatcaatcttccattcgccttttaatgagttcaggtttttcaggcgcaggctgagaattttcatgcttcgtgttctccggcgagggtatgcaacgtcgtggtgaaaagatgctgcagacgttgctgctgcgattcatccagttcttccagtgccagacggcgattgaacacctcttcgacgctgagttcgctgagggtttcacgctgttggctggctaacactcgctcgcgctgttcacgactccggcgtaccagcaatacttcgacaggcaatgattcggttaatgcctggattttgcgctgaatatcatgcagatactcatcagtagtgatttcgatatccagccagacaggtggctcctgtgatacatcgcgccactgttccagctgttcggtaatcgacgccagatcgcctttcagcaccgccatgggttgcgttaccggtacgttcaggttttccacgctctctaatttgccgtttgaaaatgtcaccagatggacatatttactcttaccgcattcatcaaaactcagtggtatgggggaaccgcaatagcgaacatgttccatgccgccaataatctgcgcgcggtgaatatgcccgagcgcgatgtagtcggctggtggaaagttttgtgccggaaacgcgtccagcgtgccaatataaatgtcacgcacggcgtcacttttactggcacccacggtcgttaaatgtcccgtggcgatgatgggcagaggctgatcgccgcgcagtttgcaggcatcggcataatgttgttgataataatcagtaatagccgccagcaaatgctgctgtttttcaataccgttaagccccgcctggctggtaataatgtcacgcggacgtaaaaacggaatagggcacagcactgcgcctggcgtcccgtcgcgacgaggcaagatttgcggcgcatgtccggcgctggcgaccacggtcgtattgaggaacgccatgatatcgcgcgattcattcagcgtggcgaccgagtcatggtttcctgccagtaccaccagatgacagccagtttgctgtaaattgacaacaaaacggttgtataacgtgcgggcgtaactggggggcgagccggtatcgaaaacatcaccggcaacaataatcgcatccacctgatgggtttgtgctgtctccagcagccagtcaagaaaagcctgatgttcagcttcgcggcttttactgtagaagttctggccgagatgccagtctgaggtgtgaaggatgcgcataacggttccctggcgaaaaagcatgggcgcgattatacccaaacagatgtgccatttgcttttttctgcgccacggaaatcaataacctgaagatatgtgcgacgagcttttcataaatctgtcataaatctgacgcataatgacgtcgcattaatgatcgcaacctatttattacaacagggcaaatcatggcgagacgtattctggtcgtagaagatgaagcaccaattcgcgaaatggtctgcttcgtgctcgaacaaaatggctttcagccggtcgaagcggaagattatgacagtgctgtgaatcaactgaatgaaccctggccggatttaattctccttgactggatgttacctggcggctccggtatccagttcatcaaacacctcaagcgcgagtcgatgacccgggatattccagtggtgatgttgaccgccagaggggaagaagaagatcgcgtgcgcggccttgaaaccggtgcggatgactatatcaccaagccgttttcgccgaaggagctggtggcgcgaatcaaagcggtaatgcgccgtatttcgccaatggcggtggaagaggtgatcgagatgcaggggctaagtctcgacccgacatcccaccgggtgatggcgggcgaagagccgctggagatggggccgacagaatttaaactgctgcacttttttatgacgcatcctgagcgcgtgtacagccgcgagcagctgttaaaccacgtctggggaaccaacgtgtatgtggaagaccgcacggtcgatgtccacattcgtcgcctgcgtaaagcactggagcccggtgggcatgaccgcatggtgcagaccgtgcgcggtacaggatatcgtttttcaacccgcttttaacgccttgctcatcggacgcagagcagggcttatgatttcttaactggagtatcttacgtgctggaacggctgtcgtggaaaaggctggtgctggagctgctactttgctgcctcccggctttcatcctgggtgtattttttggttacctgccctggtttttgctggcatcggtaacaggactgcttatctggcatttctggaatttattgcgcctttcatggtggctgtgggtggatcgcagtatgaccccgccaccggggcgtggtagctgggaaccgctgctatacggattacaccagatgcagctgcgaaataaaaaacgccgccgcgaactgggcaatctgattaaacgctttcgtagcggcgcggagtcgctgcccgacgcggtggtgctgaccacggaagagggcggtattttctggtgtaacggtctggcgcaacaaattcttggtttgcgctggccggaagataacgggcagaacatccttaacctgctgcgttatccggagtttacgcaatatctgaaaacgcgtgatttttctcgcccgctcaatctggtgctcaacaccgggcggcatctggaaattcgcgtcatgccttatacccacaaacagttgctgatggtggcgcgtgatgtgacgcaaatgcatcaactggaaggggcgcggcgtaacttttttgccaacgtgagccatgagttacgtacgccattgaccgtgttacagggttacctggagatgatggatgagcaaccgctggaaggcgcggtacgtgaaaaagcgttgcacaccatgcgcgagcagacccagcggatggaagggctggtgaagcaattgctgacgctgtcgaaaatagaagccgcaccgacgcatttgctcaatgaaaaggttgatgtgccaatgatgctgcgcgttgttgagcgcgaggctcagactctgagtcagaaaaaacagacatttacctttgagatagataacggcctcaaggtgtctggcaacgaagatcagctacgcagtgcgatttcgaacctggtctataacgccgtgaatcatacgccggaaggcacgcatatcaccgtacgctggcagcgagtgccgcacggtgccgaatttagcgttgaagataacggaccgggcattgcaccagagcatattccgcgcctgaccgagcgtttttatcgcgttgataaagcgcgttcccggcaaaccggcggtagcggattagggttagcgatcgtgaaacatgcggtgaatcatcacgaaagtcgcctgaatattgagagtacagtaggaaaaggaacacgtttcagttttgttatcccggaacgtttaattgccaaaaacagcgattaatccgcctttgtcatcttttattgccataagccagccgatgctggcttattttctttgcagtcaaaatacgggcgttagattttacaacggttggcgattttttgttcgcatgattagccatgtctttttcacggaaatagtgttttatactagttggcgatttcttatcgctatatacctctggtttttagatccctccttgctttaaaacgttataagcgtttaaattgcgcttcaggtgctgtcatactgactgcattaacgcggtaaatcgaaaaactattcttcgccgcgcctggttgggagtatttcccgctaaaattgtttaaatataccgctgtatcatccccagggattggcacaaaaatttaacgttacaacaccacatccacaggcagtatgatttatgacccatcaattaagatcgcgcgatatcatcgctctgggctttatgacatttgcgttgttcgtcggcgcaggtaacattattttccctccaatggtcggcttacaggcaggcgaacacgtctggactgcggcattcggcttcctcattactgccgttggcctgccggtattaacggtagtggcgctggcaaaagttggcggcggtgttgacagcctcagcacgccaatcggtaaagtcgctggcgtgctgctggcaacggtttgttacctggcggtggggccgcttttcgctacgccgcgtacagctaccgtttcttttgaagtgggcattgcgccgctgacgggtgattccgcactgccgctgtttatctacagcctggtctatttcgctatcgttattctggtttcgctctatccgggcaagctgctggataccgtgggcaacttccttgcgccgctgaaaattatcgcgctggtcatcctgtctgttgccgcgattgtctggccggcgggttctatcagcacggcgactgaggcttatcaaaacgctgcgttttctaacggcttcgtcaacggctatctgaccatggatacgctgggcgcgatggtgtttggtatcgttattgttaacgcggcgcgttctcgtggcgttactgaagcgcgtctgctgacccgttataccgtctgggctggtctgatggcgggtgttggtcttactctgctgtacctggcactgttccgtctgggttcagacagcgcgtcgctggtcgatcagtctgcaaacggcgctgctattctgcatgcttacgttcagcacacctttggcggcggcggtagcttcctgctggcggcgttaatcttcatcgcctgcctggtcacggcagttggcctgacctgtgcttgtgcagaattctttgcccagtacgtaccgctctcttatcgtacgctggtgtttatcctcggcggcttctcgatggtggtttctaacctcggcttaagccagctgatccagatctccgtaccggtgctgaccgctatttatccgccgtgtatcgcactggttgtattaagttttacacgctcatggtggcataattcgtcccgcgtgattgctccgccgatgtttatcagcctgctttttggtattctcgacgggatcaaagcatctgcattcagcgatatcttaccgtcctgggcgcagcgtttaccgctggccgaacaaggtctggcgtggttaatgccaacagtggtgatggtggttctggccattatctgggatcgcgcggcaggtcgtcaggtgacctccagcgctcactaaatcactgaacatttgttttaaccacggggctgcgatgccccgtggttttttattgtgttgatgggttaggaattgatggaaagtaagaacaagctaaagcgtgggctaagtacccgccacatacgctttatggcactgggttcagcaattggcaccgggttgttttacggttcggcagacgccatcaaaatggccggtccgagcgtgttgttggcctatattatcggtggtatcgcggcgtatatcattatgcgtgcgctgggggaaatgtcggtacataacccggcagccagttctttttcccgttatgcgcaggaaaacctcggcccgctggcaggttacattaccggctggacctactgctttgaaatccttattgtcgccatcgccgatgtgaccgcttttggtatctatatgggtgtctggttcccgacggtgccgcactggatttgggtgctgagcgtggtgctgatcatttgcgccgtaaacctgatgagcgtgaaggtcttcggtgagctggaattctggttctcgttctttaaagtcgccaccattatcatcatgattgttgccggtttcggcatcatcatctgggggattggcaacggcgggcaaccgaccggtattcataacctgtggagcaacggcggcttcttcagcaacggttggcttgggatggtgatgtcgctgcaaatggtgatgtttgcttacggtgggatcgaaattatcgggattaccgctggtgaagcgaaagatcctgagaaatcgataccgcgtgcgattaactccgtgccgatgcgtattctggtgttctacgtcggtacgctgttcgtcattatgtctatctacccgtggaatcaggttggcactgccggtagcccgtttgtgctgacgttccagcatatgggcattacctttgccgccagcattcttaactttgttgtgctgaccgcttcgctgtcggcaattaacagtgatgtatttggcgtaggccgtatgctccacggtatggcagagcagggcagcgcgccgaaaattttcagcaaaacctcgcgtcgcggtattccgtgggttacggtgctggtgatgactaccgcgcttctgtttgctgtgtatctgaactacatcatgccggaaaacgtcttcctggtgatcgcttcgctggcaactttcgccacggtgtgggtgtggattatgatcctgctgtcgcaaatcgccttccgtcgccgtttaccgccagaagaagttaaggcgctgaaatttaaagtaccgggtggggtagcaaccaccatcggcgggctgattttcctgctctttattatcgggttgattggttatcacccggatacgcgtatctcgctgtatgtcggtttcgcgtggattgttgtgctgttgattggctggatgtttaagcgtcgccacgatcgtcagctggctgaaaaccagtaatccttgcgttctgtaagccggttcaggaggaaatcctgatccggctattccgaaagttatccgcccccgtcctcctcccccaaatatccttcagatgatgagtgatcctgcattaggctatggcaaggtgatcagattttcatcacaggggaattatgatgttaaatgcatggcacctgccggtgcccccatttgttaaacaaagcaaagatcaactgctcattacactgtggctgacgggcgaagacccaccgcagcgcattatgctgcgtacagaacacgacaacgaagaaacgtcagtaccgatgcataagcagcgcagtcagccgcagcttggcgtcaccgcatggcgggcggcgatcgatctctccagcgggcaacctcggcggcgttatagtttcaaattgctgtggcacgatcgccagcgttggtttacaccgcagggcttcagccgaatgccgccagcacgactggagcagtttgccgtcgatgtaccggatatcggcccacaatgggctgcggatcagattttttatcagatcttccctgatcgtttcgcccgtagtcttcctcgtgaagctgaacaggatcatgtttattaccatcacgcagccggacaagagatcatattgcgtgactgggatgaaccggtcacggcgcaggcgggcggatcaacgttctatggcggcgatctggacggtatcagcgaaaaactgccgtatctgaaaaaacttggcgtgacggcgctgtatcttaatccggtgtttaaagctcccagcgtacataaatacgataccgaggattatcgccatgtcgatccgcagtttggcggtgatggggcgttgctgcgcttacgccacaatacgcagcagctgggaatgcggctggtgctggatggcgtgtttaaccacagtggcgattcccatgcctggtttgacaggcacaatcgtggcacggggggagcttgtcacaaccccgaatcgccctggcgcgactggtactcgtttagtgatgatggcacggcgctcgactggcttggctatgccagcttgccgaagctggattatcagtcggaaagtctggtgaatgaaatttatcgcggggaagacagtattgtccgccactggctgaaagcgccgtggagtatggacggctggcggctggatgtggtgcatatgctgggggaggcgggtggggcgcgcaataatatgcagcacgttgctgggatcaccgaagcggcgaaagaaacacagccggaagcgtatattgtcggcgaacattttggcgatgcacggcaatggttacaggccgatgtggaagatgccgccatgaactatcgcggctttaccttcccgttgtggggatttctcgccaataccgatatctcttacgatccgcagcacattgacgcccaaacctgtatggcctggatggataattaccgcgcagggctttctcatcaacaacaattacgtatgtttaatcagctcgatagccacgatactgcgcgatttaaaacgctgctcggtcgggatattgcgcgcctgccgctggcggtggtctggctgttcacctggcctggtgtaccgtgcatttattacggtgatgaagtgggactggatggtaaaaacgatccgttttgccgtaaaccgttcccctggcaggtggaaaagcaggatacggcgttattcgcgctgtaccagcgaatgattgcgctgcgtaagaaaagtcaggcgctgcgtcgtggcggctgtcaggtgctgtatgcggaagataacgtggtggtatttgtccgcgtgctgaatcagcaacgtgtactggtggcaatcaaccgtggcgaggcctgtgaagtggtgctccccgcgtcaccgtttcttaatgtcgcgcaatggcaacgcaaagaaggccatgggcaactgacagacgggattctggctttgcctgccatttcggctacggtgtggatcaactaaagcatctgttttatttgttacgtcgttagtcaccagccctgacactacgcagcgcaaaaaaagctgctcaatgtcagggctgagtttgttaaatatttgtcccgttcgatatgagcgatttttggtattcttttcccatgaggttatgtacaacctgctccaggataaccctgtattggagcaaagatatgacaatttcaaattcgaatttattgaaaccgtttattactggtactgagttgccgccttttaaagaggatgtcttttctaaaacagaagaacaatttaaaaaaagcccccatggcaaattgcttttcatttccggaaatgaaaacttagtaaacatttcagcggaaaaaatcgatgaaataaaaaatagcaaagatttcttttcaaatattgtaaatataataattttactcattaagcatcctgaaaaaattctgcccattcttcatggttgtcctgtagagtccatcgaactcattaagaatgcgaaacgaacggggcaatggtcatatgagatgactgataagaacgggcagagtattgaagtgtcctatattttcactgataccatagataataattatgatggaaaattatgcttaaaaatctgtaactcctgcaaccaaaatgattctagtacacatgaatataaaatagatcatcaacagttgaaaaatcacataaggcaacttgaggagtgggcccttcttgaaaagttttatgatagcaacgcttattattctaaacgtacaaaacaattagagaagaaaattgccgatgcggggtttatagcagggaaggttaatgccgataactttaatgtaaaagagtttagagccgatatagcctcgatgctttgtgaacagccccccatgcgaacacaccagatttcttcatccggatacttatctgccgataaagtgcccgatctctataagacaaatttgaaagacgcgcagagagatctgaaaacaacaccggttgacatcgatggtgttagtctaaaatcaaaaactcgggaaaaaattgcggaaaaaattgcgaaaaaaactgaggaagaaaatgcgaaaaaaacagcggaaataattgcgaaacaaaatgcgaagaccattgaggagaagaatagtgaaaaaaacaagaaagaatcaaatcctgaggataattttgtcttaaaattctcaccggaagaaatcaatgagatgctcctggattacagcgatgaagaacaaaaaaaattaagaccttttttcactagtgatcacatctattgtttgtttgatgcttttagtcaggatttgcataatgttgctcgtaatggcagtccacggtatgcaggtttactacgtcaaatagcatccaagactgcgaaattacaagatattgatcaactattgttctggcgcacgttttcaggaggggtcttccatcgacgtatctctgtgaacagcgagccagaaaagacagatgtatggcgattcagtagccaatttgattttccacatataaatgaaaacggagagttatccagaacggtactcatgttcgagggggttgctgaaagcaactttaaagatatcgccaatcattccagcgaatgttttacttacagttgttatgccgccccgctggatgcgaatgctaaaaaatagtgacgccggagtttgaagtttcagagcgccttgcgtgacgcctgcgccatcatccgcggataaaactgccagaagcgggtttcgagagcatcgtaatgggcgtctaaatcgtaccaggagtcacgcagggcatccagacgtgggcgacggcttgccatgccgtttaacacgttctggatgaaatccatatcgcgatagcgcaccagccactgctctgaccataagtagttgttcagattgataaagcgtggcggtgagtccggcaaaatcgtcatcacttgctcgcgggcataacaaacaaattcctgtagtggaaagtccggcgacagctgcgaccagtggcgggaaagaaagtgatcccacatgacatccagggtaataggcgcaacgcggcgggtttcactacgaaaccactcccgtgcttcgcggacttccggcagattgtcagtcaatacgtcgatacgtcgatgcatatgaatgccagccacgacgtcgggcggaaaactttcttcaggatttccgcgtacgaaatcagccagcaaattgccggaaagcgagctttccgccaggtgagctagatgcaggtgagctaaaaaattcatatacacttcatccttcaaactgcctcttcgttggctgccttcactcaccccagtcacttacttaatgtaagctcctggggactcattcagttgccatctcgatgcatcttgaatgattttgtgtatagattatgtcatccatcaaggagggtaaaggttgcagggagagcgccccggcactagactacctgcctcttattttagtctgagtcagtgtcatgcgcgttaccgatttctcctttgaattgcccgaatccctgattgcccactatcccatgcctgaacgcagtagctgtcgtttactgtcgctggacgggccgacgggcgcgctgacgcacggtactttcaccgatttactcgataagctcaaccccggcgatcttctggtttttaataatacccgcgtgatcccggcgcgcctgtttgggcgtaaagccagcggcggcaagattgaagtgctggttgagcggatgctcgacgacaaacgcattcttgcgcatattcgcgcctcgaaagcgccaaaacctggcgcagaactgctgctgggcgatgacgaaagtatcaacgcaacgatgaccgcgcgccacggcgcactgtttgaagtcgaatttaatgatgatcgttcggtactggatatcctcaacagcatcggccatatgccactgccgccgtatatcgaccgtccggacgaagacgctgaccgcgaactttatcaaaccgtttatagcgaaaaaccgggcgcggttgcagccccgaccgctggtctgcattttgacgagcctttgctggaaaaattgcgcgccaaaggcgtggagatggcgtttgtgacgttgcacgttggtgcgggtactttccagccggtgcgcgtcgacaccattgaagatcacatcatgcactcggaatacgctgaagtgccgcaggatgtggtagacgcggtactggcggcgaaagcgcgcggtaaccgggtgattgcggttggcaccacttctgtacgttcgttggaaagcgcggctcaggcagcgaaaaacgatctcattgaaccgttcttcgacgatacccaaatctttatctatccgggcttccagtacaaagtggtcgatgcgctggtgacgaacttccacttgccagagtcgacgctgattatgctggtttcggcctttgccggttatcaacacaccatgaacgcctataaagcagcggtagaagagaaatatcgcttttttagttacggtgatgcgatgtttatcacgtacaatccgcaggcaattaatgagcgcgtcggggagtaattccgcggcgctggtttaaaacgttggactgtttttctgacgtagtggagaaaaaatgaaatttgaactggacaccaccgacggtcgcgcacgccgtggccgcctggtctttgatcgtggcgtagtggaaacgccttgttttatgcctgttggcacctacggcactgtaaaagggatgacgccggaagaagttgaagccactggcgcacaaattattctcggtaacaccttccacctgtggctgcgcccgggccaggaaatcatgaaactgcatggcgatttgcacgattttatgcagtggaaaggcccgattcttaccgactccggcggcttccaggtcttcagccttggtgatattcgtaaaatcaccgaacagggcgtgcacttccgtaacccgatcaacggcgacccgattttcctcgacccggaaaagtcgatggagattcagtacgatcttggttcggatatcgtcatgatctttgatgagtgtacgccgtatcctgctgactgggattacgcaaaacgctccatggagatgtctctgcgttgggcgaagcgtagccgtgagcgttttgacagtctcggaaacaaaaatgcgctgtttggtatcattcagggcagcgtttacgaagatttacgtgatatttctgttaaaggtctggtagatatcggttttgatggctacgctgtcggcggtctggctgtgggtgagccgaaagcagatatgcaccgcattctggagcatgtatgcccgcaaattccggcagacaaaccgcgttacctgatgggcgttggtaaaccagaagacctggttgaaggtgtgcgtcgcggtatcgatatgtttgactgcgtaatgccaacccgcaacgcccgaaatggtcatttgttcgtgaccgatggcgtggtgaaaatccgcaatgcgaagtataagagcgatactggcccactcgatcctgagtgtgattgctacacctgtcgcaattattcacgcgcttacttgcatcatctcgaccgttgcaacgaaatattaggcgcgcgactcaataccattcataaccttcgttactaccagcgtttgatggcgggtttacgcaaggctattgaagagggtaaattagagagcttcgtaactgatttttaccagcgtcaggggcgagaagtaccacctttgaacgttgattaatattaataatgagggaaatttaatgagcttttttatttctgatgcggtagcggcaacgggtgcaccggcgcaaggtagcccgatgtctttgattttgatgctggtggtattcggtctgattttctatttcatgatcctgcgtccacagcagaagcgcaccaaagaacacaaaaagctgatggactccattgccaaaggtgatgaagttctgacgaacggtggcctggttggtcgcgtaaccaaagtagcggaaaacggctacattgctatcgcgctgaatgacaccactgaagtagttattaaacgtgacttcgtagctgccgtcctgccgaaaggcaccatgaaggcgctgtaattaaaatttttccctaagggaattgccgtgttaaaccgttatcctttgtggaagtacgtcatgctgatcgtggtgattgtcatcggtctgctgtatgcgcttcccaacctgtttggtgaggatccggctgttcagatcactggtgcgcgcggagtcgccgccagtgagcaaacgctgatccaggtccagaaaacgttacaagaagaaaaaataactgctaagtctgtggcactggaagagggcgctattcttgcgcgcttcgactccactgacacccaactgcgcgctcgtgaagcattaatgggcgttatgggtgacaaatacgtcgtggcgcttaaccttgccccggcaacgccgcgctggctggcagctattcacgctgagccgatgaagctcggccttgacctgcgtggcggcgttcacttcctgatggaagtggatatggacaccgcgcttggcaaactccaggaacaaaacatcgatagcctgcgcagcgacctgcgcgaaaagggcatcccgtataccaccgttcgtaaagaaaacaactacggcctgagcatcactttccgcgatgctaaagctcgtgatgaagccattgcgtatctgagcaagcgccatccggacctggtgattagcagccagggcagcaaccagctgcgtgcggtaatgagcgatgctcgcctgagtgaagcgcgtgaatatgcggtgcagcagaacattaatatcctgcgtaaccgtgtaaaccaacttggtgtggcggagccggtggttcagcgtcagggtgctgaccgtatcgttgttgaactgccaggtattcaggacaccgcgcgtgcgaaagagattctgggtgcgacggcaacgctggaattccgtctggtaaacaccaacgttgatcaggccgcagcggcttccggccgcgtaccgggcgactctgaagtgaaacagacccgcgaaggtcagccggttgtgctgtacaaacgcgtaattctgaccggtgaccatatcactgactccacttccagccaggacgaatacaaccagccgcaggttaacatctcgctcgatagcgctggtggtaacattatgtctaacttcaccaaggacaacatcggcaaaccgatggcgaccctgtttgtggagtacaaagacagcggtaagaaagatgcaaatggtcgtgcggttctggtgaaacaggaagaggtgattaacatcgccaacatccagtctcgtctgggtaacagcttccgtatcaccggcatcaacaacccgaacgaagcccgtcagctgtcactgctgctgcgtgccggtgcgttgatcgcgccgattcagattgttgaagaacgtaccattggcccgaccctgggtatgcagaacattgagcaggggctggaggcttgccttgccggtctgctggtttctattctgttcatgatcatcttctataagaagtttggtctgattgcgaccagtgctctgattgccaacttgatcttgattgtcggcattatgtcgctgttgccaggcgcaacgctgagtatgccaggtatcgcgggtatcgtcttaacccttgcggtagcggtcgatgcgaacgtacttatcaacgaacgtattaaagaagagttgagcaacggacgtactgttcaacaggcaattgatgaaggttatcgtggcgcattcagttccatcttcgatgcgaacatcaccacgctgattaaagtcatcatcctgtacgcagtgggtaccggggcaattaaagggttcgcgattactaccggtatcggtgtggcgacgtcgatgtttaccgcgattgtcggtacgcgtgccatcgtaaacctgctatatggcggcaagcgcgtcaagaagctgtcaatctgaggagtgcgatgtggcacaggaatatactgttgaacaactaaaccacggccgtaaagtctatgactttatgcgctgggactactgggcttttggcatctctggtctgctgttaatcgccgctatcgttattatgggcgtgcgcggctttaactgggggctggatttcaccggtggtacggttatcgaaattacgctcgaaaaaccggctgaaattgacgtaatgcgtgatgcattgcaaaaagccggttttgaagagccgatgctgcaaaactttggtagcagccacgacatcatggtccgtatgccgcctgctgaaggcgaaaccggcggtcaggtgctgggcagccaggttctgaaggtgattaacgaatccaccaatcagaatgcggcagtgaagcgtattgagttcgtcggtccgagcgtgggggcagaccttgcgcaaaccggtgcgatggcgttgatggcggcgctgctatctatcctcgtgtacgtaggtttccgctttgagtggcgactggcggcaggggttgttattgcgctggcgcacgacgttatcattacgctgggtattttgtcgttattccatatcgagattgacctgaccattgtggcatcgttgatgtcggttatcggttactcgcttaacgacagtatcgtggtatcggaccgtattcgcgaaaacttccgcaagatccgtcgcggtacgccttacgaaatctttaacgtgtccttgacccagacgctgcaccgtaccttgatcacatccggtactaccttgatggttatcctgatgctgtacctcttcggtggtccggtactggaaggcttctcgctgaccatgcttatcggtgtttccatcggtactgcatcttccatctacgtagcatcggcgctggctctgaaactgggtatgaagcgcgaacacatgctgcagcagaaagtggaaaaagaaggggcggatcagccgtcaattctgccgtaatcaagttcccgttgatgttgaaaatcccggtcagaagatcgggattttttttgatgtatggagattgcgaaaatccccgcatcttgggaaactgcgcgtaaccctacatttcatccaggtaacttttcatggctatcatccctaaaaactatgcgcggttagaaagcggctatcgcgaaaaagcattaaaaatctatccgtgggtctgcggtcgctgttctcgcgagtttgtttattccaacctgcgtgaacttaccgttcaccacattgatcacgaccataccaataacccggaagacggcagtaactgggagttattgtgtctttattgccacgatcacgagcattcaaaatataccgaagcagatcagtatggtacgaccgttatcgcaggggaagatgcgcagaaagatgtcggtgaagcgaagtacaacccattcgctgacctgaaagcgatgatgaacaagaagaagtgataaaaaatgccggatatggaatccggcattctcacaattagaagttgtaacctactaccaggtaaccaccccagccggtagagcgaacgttgaagttgccgttgccgaagttcagttctgcatcgtcgttccactgaccaccgtcgtgccagtaacgagctacgacagagtagtgccagtgatcgtagttcagagccagaatatggctggaagcgatggagttattggtacgggtcttaataccgttgattgcattaccgctgtcatcccctaaatcggaaccccagtcgaagttggtgaagccgatgtagctcagctgaccgccccacagatcggtaatcggcacaaagtatttaattttgaaacggtaaccgtcccactcgttttcattcgctgcgccatagttctgccactggtatttcgcatagacgttcatggacaggctcatcggcaggccagtatcgatatcggtacccagacccatgtaccaggtgctctggcgaccatctttattacgacccatgtcgtaaatgtagttgttcgcgaagtaccactctttgaacggaccaaagctaaggtcagtattggtcagcttgtcgatggagaaacgtggttcgatttccataaacagcggagaaccgtggttccagataccttttgcatcggagttaccgccgaagaataccggcgcatccgcataaccatagaagtcgaaccagtcttttttagcgaatgcttcgtactcaaggtaggtatcgttgcggatctgcggtccgaaacgggtgtgatagcttccgacaacgttaacgctctggtgccaccagtcggaaagatactgcggtttgtcgttttcagctgcgttgacagtaaaagacgaagagagcgccagtaccgcaccggctgccagtaatgtttttttcatatgtatgccactgtttgaaaatcccttgcgggagtgaaaaaggcgcaaattgcgtttctaaatatttcgtatacagaggagcctattataaaaatcattgctcacaaaaatatgtttcgtttcacagttctatcatttacgtaatcgattgcgttcacgtttacacacattcgggcggggattgtactgactttcacccttgttgcaaacttttactatcaatccaggtgatgtaagcggagtaacaaaatgacgggaaaagatgttgcgggacgcacaaaatcgccccgcgatacgtttactgcataacaggttgaatgtcgtggatacgtaaaaagcctaactgatccatagaaataccctttaactgtaacggaatatcaacatcgctgggggcgaggacgctggcaggggcgttaatcaattgattctgcacattgatttcctgaaagttgtctattgttccctgaatttgcccatattcaacagttccgctgaatgcgggcaagggatcattcgactcgccctcaatacgtagcgtcagggtggtgccatctatatcaggcgtaatattcaccagcgacatacgtaaagtaccgatctggctttccagtcttgctggtgttttcgctccaggcagaaggtaaaccccactgctggattttgcattcagcctgttttgctgagtgatttttaccgtttctttattgagttgcgtcatctcctggttcagtgtgctgacgctgtgtttcatctgccgcacttcgctttgctgcacacaggcgctaaggctaaacaggcttcccagcaggagcagtcgaaaaacgttagtattcataggtcgtccctttctcgtcgcaattagcctaatggtagagggtaaaagcagcgaaagcatcgatcctttatctcaaaagcgttgcgcctttgttgtatcgtcagttcagggtaaaatagatttctgttaaccacctggtcaggacgccgtatgcattgcccattctgtttcgccgtggacactaaggtaattgactctcgtctcgtgggcgagggctcatctgtacgccgccgtcggcagtgtctggtgtgtaatgaacgtttcaccacctttgaagtggcggagctggttatgccgcgtgttgtaaaaagcaacgacgtgcgtgaaccgtttaatgaagagaaattgcgtagcggaatgctgcgggcgctggaaaaacgtccggtgagttccgatgacgtcgaaatggcaatcaatcatattaaatcgcagctgcgcgccaccggtgagcgcgaagtgccgagcaagatgattggcaatctggtgatggagcaattgaaaaagctcgataaagtcgcctatatccgttttgcctctgtctaccgcagtttcgaagatatcaaagaatttggcgaagagatcgcgcgcctggaggactaagccgtgcaggacgagtattacatggcgcgggcgctaaagctggcgcaacgaggacgttttaccacgcatcccaacccgaatgtcgggtgcgtcattgtcaaagatggcgaaattgtcggtgaaggttaccatcaccgtgctggtgaaccacacgccgaagtacatgcgttgcgtatggctggagaaaaagccaaaggtgcgactgcgtatgtgacactcgaaccttgcagccatcacggccgtacgccgccttgctgtgatgcattaattgccgcaggtgtggcgcgcgtggttgcctcgatgcaagatcctaacccgcaggtcgctgggcgagggctatatcgtctgcaacaggctggcattgacgtcagccacgggctgatgatgagtgaagccgagcaattgaataaaggctttctcaagcggatgcgcaccggctttccttatattcaattaaaacttggcgcatcgcttgatggccgcacggcgatggtgagcggcgaaagccagtggatcacttcgcctcaggcgcggcgcgacgtacaacgactgcgcgcacaaagtcatgccattttaaccagcagtgccacggtgctggcggatgatccggccttaacggtgcgttggtctgaactggatgaacaaactcaggggctctacccgcaacacaatctccgccagccggtacgtattgtgattgatagccaaaatcgcgtgacgccggaacatcgcattgtgcagcagcccggcgaaacctggttcgcgcgtacgcaggaagattctcgtgagtggccggaaacggtgcgtaccttgctgattccagagcataaaggtcatctggatctggttgtactaatgatgcaactgggtaaacagcaaattaacagcatctgggtggaagcggggccaacgctcgctggcgcattgctgcaggcgggtttagtcgatgagctgattgtctatatcgcacctaaactattaggcagcgacgcccgtggattatgcatactaccagggcttgagaaattagctgacgccctccaatttaaattcaaagagatacgtcatgtaggcccggatgtttgcctgcatttagtgggtgcatgatctcccggctcgaaagggaagcagcgcacgaaatattatgctaaaatccgcccccctgcggggccatactcgaacccgaaggaagaaaatgaacattattgaagctaacgttgctaccccggacgctcgcgtcgccatcaccatcgcgcgtttcaacaactttatcaatgacagcctgctggaaggtgcaattgacgcactgaaacgtatcggtcaggtaaaagatgaaaacattaccgttgtttgggtgcctggtgcctatgagctgccgctggcggcgggtgcactggctaaaaccggtaaatacgacgcggtgattgcgctgggtacggttattcgtggtggcactgcccactttgaatatgtcgctggtggtgcaagcaacggcctggcgcatgttgcccaggacagcgaaattccggttgcttttggggttctgaccactgaaagcattgaacaagcgatcgaacgtgctggcaccaaagctggcaacaaaggtgcagaagctgcactgaccgcgcttgaaatgattaatgtattgaaagccatcaaggcctgaaattagtaaggggaaatccgtgaaacctgctgctcgtcgccgcgctcgtgagtgtgccgtccaggcgctctactcctggcagttgtcccagaacgacatcgctgatgttgaataccagttcctggctgaacaggatgtaaaagacgttgacgtcctgtacttccgtgagctgctggccggggtggcgactaacaccgcatacctcgacggactgatgaagccatacctgtcccgcctgctggaagaactgggccaggtagaaaaagcagtactgcgcattgcgctgtatgagctgtctaaacgtagcgatgtgccatacaaagtggccattaacgaagcgatcgaactggcgaaatcgttcggcgcagaagacagccataagttcgtcaacggcgtactcgataaagcagcacctgtgattcgccctaacaaaaagtgatatccaggccggtagattcacggaagaccgttccgcgatcgccggccttttcttttttacctgctgaggcataacgtatggcatgtggcgagttctccctgattgcccgttattttgaccgtgtaagaagttctcgtcttgatgtcgaactgggcattggcgacgattgcgcacttctcaatatccccgagaaacagaccctggcgatcagcactgatacgctggtggcgggcaaccacttcctccctgatatcgatcctgctgatctggcgtataaagcactggcggtgaacctaagcgatctggcagcgatgggggccgatccagcctggctgacgctggcattaaccttaccggacgtcgacgaagcgtggcttgagtccttcagcgacagtttgtttgatcttctcaattattacgatatgcaactcattggcggcgataccacgcgtgggccattatcaatgacgctgggtatccacggctttgttccgatgggacgagccttaacgcgcgctggggcgaaaccgggtgactggatctatgtgaccggtacaccgggcgatagcgccgccgggctggcgattttgcaaaaccgtttgcaggttgccgatgttaaagatgcggactacttgatcaaacgtcatctccgtccatctccgcgtattttacagggacaggcactgcgcgatctggcaaattcagctatcgatctctctgacggtctgatttccgatctcgggcatatcgtgaaagccagcgactgcggcgcacgtattgacctggcattgctgccgttttctgatgcgctttctcgccatgttgaaccggaacaggcgctgcgctgggcgctctctggcggtgaagattacgagttgtgtttcacggtgccggaactgaaccgtggcgcgctggatgtggctctcggacatctgggcgtaccgtttacctgtatcgggcaaatgaccgccgatatcgaagggctttgttttattcgtgacggcgaacctgtcacgttagactggaaaggatatgaccattttgccacgccataaagatgtcgcgaaaagtcgcctgaagatgagtaatccgtggcatctgcttgctgtcggattcggaagtggattaagcccgatcgttcctgggacgatgggctcgctggcagcgattccgttctggtatctgatgacctttttgccctggcagctctactcgctggtggtgatgctggggatctgtatcggcgtctatctttgtcatcagaccgcaaaagatatgggcgtgcacgatcacggcagcattgtctgggacgaatttattggtatgtggatcacgctcatggcgctgccgaccaatgactggcagtgggtcgccgccgggtttgtgattttccgtatcctggatatgtggaaaccgtggccgatccgctggtttgaccgcaatgtacatggcggcatggggatcatgatcgacgatattgtcgccggggtaatttccgcaggcatcctgtactttatcggtcatcactggccgctgggtattctttaatgccattgaccgggaggtgtaggcgattccagaccacccggtttgatttataaatgaacagtgccccaattttgaggcactctgttaaagtaaaatccgacatcaccgaatatattatgcggagatatttcaaggtgtaactttgtcactcataattcaatgacactgaaatatcgtcagtcgacgaactcataataattactcatatattctgactgttgccgaaaaatatcatcaaaattatccttaatggttttgtttatagtgttgaataaatttttagaaagttcatctattttgtcttgaatctttggttttatttcatcttgaatttcacgggtaaccaaaagttggtccaattgatcatccattttgtattttgcaattaattgtgcagttaaaggtattttctttaaataatcattttttgttattttatactggtcgatgaaatattgtctggcttgttcttgtttatagttaaaaatctcattgtatttttttctgcttatttttccttcaagattcattgcttgattgaatatgctctttaaatgctgattatagaaaataaaattatcgatatcttgtattattttagtggttgttgatttttcatcaaattttaatgactcagggtttttatctgattcaatatagtcaagaataatttttgctaatgggctaatatctttttcttctgttgattctgcttctgcttttaatatcggattaaaaaggtcggtacggtaaagtttcgtgcctttcatcctgacgatgtcaggaagaatagtgtttgaaagattagcctcgctaaagtccacattttggcaatcactttctgataaatctgcccaattgaaagtggttttaacacaggagcagttagttagaatcatccctttcgtttcattcccatgtgatttctgataagttatcctttgtattatttgatctgcttctggatattgcatctcaggttctttttctttaccatatatcaccgcattatcaagaattgcgccagtgcaattcatatttgttagatcgcatttgataaatctacaactgttaaaattcgcatttgtacaattcgtatttgtaaacttgacgctatcaaaataagtatgttcgaagttgacatttgagcagttacagtttcccagatctataccgaaatctatagcgggatctttattgggatctttaccggaaatattgctgtgtgctagatatagaccgctgaaatcgtaatatccattgtcatccttttctattgggagtgaataagtctttactacctcgttaacaatagagatagttccacgtatcatcagattttctccgactttataaaaaataatgttatgtttgatggtgctgttgtatggctctggcaatgaggatgcaattttattccagaaacaacaaagcgtggtctgcttttgtttgggcgagaggttatcaaatttcaggtttaaatatgagtctaaatctgacgatgcatctatattaaaattgggatctggagttaacgctgaattataatttagaactgacaatgtattgatgtatttatgaatcgatttaaatgccttttgtttatcactgtccagaaaaaaatcacgaattttgttccatagcctttcgataagattttgatttaaatcgtgcttcattgagtttcttaaatctgcaaccggtacatcagtaaacaggatcggttgtttggtgatagttttcatcatgattgtaatcctcttacgttgactaaataagacagttttagggagtattacctggagaaactatcaaaaatcgctcaaagggatgaagatgatgaatagctgcaaactcattcacgaagaatttctcttgcagaggtggattatggttacagaagatgatgggaggtacgttgtccccatcatcgcagacgatggggaattcagcagataaaatggctgaaaagcgaaatttacttaaatcctacgaccggatgcggtttatacggcgtttccagttcagcaatctgttccggcttcaaggtgatatccaccgcgttcagcagctcatcaagctgttcttcccgcgaagttccgataatcggtgcggcaatgccccgtttactcaacaaccaggccagcgcaacttgtgctcgtgttgcacccagttcttcactgacgcccgttaaccgctctgcgatctgcgcgtcattttcatcgctttctttatagagatttttccccacctcatcagacaccagtcgtgcggtagtttctccccacggacgtgtcagacgaccccgcgccagcgggctccatggaatcaccgctacgccctcctggtaacacagtggcagcatctcgcgctcttcttctcgataaatcagattgtagtgatcctgcatactgacaaactgcgcccagccgtgctgtttttgtagttccagtgcctgagcaaactgcgaagcgtgcatggatgacgcgccgatataacgcgctttcccggcttttaccacgtcgttcagggcttccagcgtctcttcgatcggcgtgttgtaatcccagcgatgaatttgcaggatatcgacataatccatgccgagacggcgcaggctgtcgtcgatagagcgcaatatttgcgcacgggataatccttccggcaaatcaccaacgcgatggaacactttggtggcaacgaccacgtcttcacgacgggcgaaatcccgcagtgcgcgaccaacgatctcttcgctgctgccatcggaatagctattggcggtgtcaaagaaatttatgccgccttccagcgcgcgtttaattatgggacgactgctctcttccggcagtgtccatgcgtgattaccacgatctggctcgccaaaggtcatacagccgaggcaaagtcgggaaacgcgaaggtcggtttttcctaaggggttgtattgcatgctgccactcctgccatgaataatttcttaagcatagcaggagtggagtagggattatgccagccaggccttgattttggcttccataccggcggcatcgaggctgagttcggcgcgcatttcttcctgcgttccttgtggaataaagaagtcaggcaggccaatgttcagcacgggtactggtttacgatgggccatcagcacttcgttcactccgctgcctgcgccgcccataatggcgttttcttctacggtgaccagcgcttcatggctggcggccatttccagaattaacgcttcatcaagcggtttcacaaaacgcatatcgaccagcgtagcgttcagcgattcagcgactttcgccgcttctggcatcagcgtaccaaagttaaggatcgccagtttctcgccacgacgcttcacaatgcctttgccaattggcagtttttccagcggcgtcagttccacgccaaccgcgttgccacgcgggtagcgtaccgctgacgggccatcgttatagtgatagccggtatagagcatctggcgacattcgttttcatcgctcggggtcataatgaccatttccggtatgcagcgcaggtaagagagatcaaaagcgccctggtgggtttgaccatcagcaccaacaatgcccgcgcggtcgattgcgaacaggaccggaagcttttgaattgccacgtcatgcagcacctgatcataggcgcgttgcaggaaagtggagtagatcgcgacaacgggtttgtagccaccaatcgccagacccgccgcaaaggtcactgcgtgttgctcggcaattgccacgtcgaagtagcgatccgggaatttacgtgaaaactcgaccatgccggaaccttcacgcatcgccggagtaatcgccatcagcttgttatctttcgccgccgtttcgcacaaccagtcgccaaagatttttgaatagctcggcaaaccgccgctacttttcggcaaacaaccgctggagggatcaaatttaggcacggcgtggaaggtgattgggtctttttctgccggttcataaccacgaccttttttggtcatgatatgcaggaactgcggtcctttcaggtcgcgcatgttcttaagcgtagtgataagccccagcacatcgtgaccgtcaaccgggccgatgtagttaaagcccagctcttcaaacaacgtgccaggcactaccatgcctttaatatgttcttcggtacgtttgagcagctctttaatggggggcacgccagagaaaacttttttcccgccttcgcgcagtgaagagtaaagcttaccggaaagcagttgcgccagatggttgttgagcgcgccaacattttcggaaatcgacatttcattgtcgttgagaaccaccagcatatcaggacggatatcgcccgcgtgattcatcgcttcaaacgccatgccagcggtaatagcgccatcgccaatgacacagacggtacggcgatttttgccttctttctcggcagcaaccgcaataccaattccggcactgatggaggttgatgaatgcccgacgcttaatacgtcatattcgctctcgccgcgccacgggaacgggtgcaggccgcctttctgacggatggtgccgattttgtcgcggcgtccggtcaaaattttatgcggataagcctgatgccccacatcccaaatcaattggtcaaacggggtgttgtagacatagtgcagcgccacggtcagttcgaccgtgcccagcccggaggcgaagtgcccgctggaacggctcacgctgtcgagtaaatagcggcgcagttcgtcgcagagtttcggtaaactctctttcggcaacagtcgtaactcctgggtggagtcgaccagtgccagggtcgggtatttggcaatatcaaaactcatcaggggcctattaatacttattgtttatttattacgctggatgatgtagtccgctagcgcttccagtgccgaggtatcgagtgactgttcagccagttgtttcagcgactgacgggcatcgtcgatcagatcccgggctttcttccgggcttgctcaagacccagaagtgcagggtaggtacttttaccaagttgctgatcggcaccctggcgttttcctaacgttgcagtatctcctaccacatccaggatgtcatcctgaacctggaaggcaaggccgatgctctctgcgtacttgtcgagtactggcagagcacgacgtcctttatctccggcgcttaatgcaccaaggcgaacggcggcgcgaatcaatgcgccggttttatgacgatgaatacgctcaagcgcgtccagaggtacgtgtttgccttccgcatctaaatctaatgcctgaccaccgcacattccggcaataccgctggcgctcgccagttctgaaatcatcgaaattctgtcgcgatccgacacttccggcatatcggcatcgcttaaaatcgagaacgccagcgtttgtaaagcgtcgccagcgagaatcgcgtttgcttcgccaaacttcacatggcaggttggcaaaccgcgacgcagatcgtcatcatccattgccggtaaatcatcatgaattaatgagtaagcgtggatacactctacggcggcagcgggtgcgtccagcgtgtttgtgctaacgccgaacatatgaccggtggcataaaccaggaaaggtcgcaggcgcttaccacctaataatgcgccatactgcatggtttcgaccacgggagtgttctgaaagggcagtggggcgataaaacggctcagcgcctggttggcctgcttaacgcaggcttcgagttgctgcggaaagtccattactcattgtccggtgtaaaaggggttagagaggcgtcttcattgtcagacagcagaatttgtacgcgctgttcggcttgttgtaatttggcctgcccctgacgtgccagctgcacgccgcgttcgaactcgttcagcgcctcttccagcggcaggtcgccactttccagacgggttacaatctgttccagctcgctcagcgccttttcaaagctggcgggcgcctcatttttcttcggcataatgaatgtctgactctcaatatttttcgccccgtcatggtaacggactcagggcaaatagcaaataacgcgcaatggtaaggtgatgtgcgcagcaaagcgatgttagtggtatacttccgcgcctggatgcagccgcaggtgtgggctgctgtatttttccctatacaagtcgcttaaggcttgccaacgaaccattgccgccatgaagtttatcattaaattgttcccggaaatcaccatcaaaagccaatctgtgcgcttgcgctttataaaaatccttaccgggaacattcgtaacgttttaaagcactatgatgagacgctcgctgtcgtccgccactgggataacatcgaagttcgcgcaaaagatgaaaaccagcgtctggccattcgcgacgccctgacccgtattccgggtatccaccatattctcgaagtcgaagacgtgccgtttaccgacatgcacgatatttttgagaaagcgttggttcagtatcgcgatcagctggaagggaaaaccttctgcgtacgcgtgaagcgccgcggcaaacatgattttagctcgattgatgtggaacgttacgtcggcggcggtttaaatcagcatattgaatccgcgcgcgtgaagctgactaacccggatgtcactgtccatctggaagtggaagacgatcgtctcctgctgattaaaggtcgctatgaaggtattggcggtttcccgattggtacccaggaagatgtgctgtcgctcatttccggtggtttcgactccggcgtttccagctatatgttgatgcgtcgcggctgccgcgtgcattactgcttctttaacctcggcggcgcggcgcatgaaattggcgtgcgtcaggtggcgcattatctgtggaaccgctttggcagctcccaccgcgtgcgttttgtcgctattaatttcgaacctgtcgtcggggaaattctcgagaaaatcgacgacggtcagatgggtgttatcctcaaacgtatgatggtgcgtgccgcgtctaaagtggctgaacgttacggtgtacaggcgctggtcactggcgaagcactgggccaggtgtctagccagacgctgactaacctgcgcctgattgataacgtctccgacacgctgatcctgcgtccgctgatttcttacgacaaagagcacatcatcaacctggctcgccagattggcactgaagactttgcccgcacgatgcccgaatattgcggtgtgatctccaaaagcccgacggtgaaagcggttaaatcgaagattgaagcggaagaagagaagttcgacttcagcattctcgataaagtggttgaggaagcgaataacgttgatatccgcgaaatcgcccagcagaccgagcaggaagtggtggaagtggaaaccgtcaatggcttcggcccgaacgacgtgatcctcgatatccgttctatcgatgaacaggaagataagccgctgaaagtcgaagggattgatgtggtttctctgccgttctataaactgagcaccaaatttggcgatctcgaccagaacaaaacctggctgttgtggtgtgagcgcggggtgatgagccgcctgcaggcgctctatctgcgcgagcagggctttaacaatgtgaaggtatatcgcccgtaatttgtggtttttacgtcgcatctggtcagatgcgacgtttgccgcatccgccactactcgtaataattataaatccctgccgccatcaccagttgtgatgccacttcatgggctttttcacgcccaaccagcaggtcgataattttcagaccaaagtcgatagctgtacccggcccctgactggtcagcaattttacccgtgcatcccagacgacgcgcttgtcctgccattgttcggcgggtattttgtctttcagcgtcgggaagccggtcatattgccaatcgggaagatatcgtgcggcaccagcacggtggctggcgcggcgcaaatagccgcgacgatacgcccggaacggtggaactgtttaacggtttcaaccagcagagtgctatcgcgaaaacactctgcgcctttaatgccaccaggcagcacgatcacgtcatattcaccgtcagccacttcgaccagcggcgcatccgccagcagcttcacgccgcgcgagcaggtaatggccaggttgccatcgctggcgacgctggcagtggtgactttgattccgccacgaaccaagaggtcgatagtggtgacggcttcagtctcttcactaccaggggcgaggcaaaccagtgccgatgcgctcatattcactctcctttctttttaccatttcaaacaggcgggtgttttccggtacggcaatcccatgcgcgcgggcgcggcgtaagagaaaaccattgatatagtcgatttcggtgtggcgcagcgcacggatatcctgcaacatcgacgagatattttccgctgtggcatcaatcacctgcatcacgtaatcacgcaaatcttctgctgaagtatgatgcccttcgcgttcgattactgccgcgacttcttcgcatatctgcataatttcttgcggatgatgacgtaattcaccattcgggcaattccagatggcggtcagtggattaatcacacagttgactgccagcttgcgccacagctcggcgcgaatattgttatgccacgcgacgtcaggtaacacggtttgcaaaatatccgccagataactgtaatcgccgtcctgttgccgtgccggaccaatatgcgtgattccgtttgccacatgaataatgacattgccgtcgcggcgggcggcatgggtggtggtgcccatcagtaatggctgctgaatgttttgcaactcttcgatggtgcccatgccgttgtgaattaacagtattggcgtagttacaggcagtgtggacgcgaggcttttgacggcatcggaaacctgccatgctttcagcgtcaccaggagcagatcgctggtggcgagaaaatcgggatcgttggcggtcagcgattcgttaaatatcgaaccatctgtctcaaccagattcacactacaataaggttgtggtacgcgcagccagccctgaacctcgtgaccctgtttacaaagtgctgtaagccataattgccctaaggcaccgcatcccaatacggtaattttcattgttcctcctcacccgcaaccactccgggtgttcaataaggctatcccttaattgtgcatgctgttgcgactatgcacaattaagggatacgtcctggtgcaggactgttggttatttaactttgcaggtattatgcttcgcatcaaaaatgaagggagaggaaaagatgccatctttcgatattgtctctgaagttgatcttcaggaagcacgtaacgcggtcgataacgcgagccgcgaagtggagtcccgttttgacttccgtaatgttgaagcctcatttgagctgaacgacgccagcaaaaccatcaaagtgttgagcgagtccgatttccaggtcaatcagttgctggatattctgcgtgccaagctgctgaagcgcggcattgaaggcagttcgctggatgtaccggaaaatatcgttcatagcggtaaaacctggtttgtggaagcgaaactgaaacagggcattgagagtgcgacccagaagaaaatcgtcaagatgatcaaagacagcaaactgaaagtgcaggcgcaaattcagggcgatgagatccgcgtaacgggtaaatctcgtgatgatttgcaggctgtcatggcgatggtacgtggtggcgatctcggtcagccgttccagttcaaaaacttccgcgattaatcgcgacaatgtgcgttttgttcatgccgaatgcagcatgaacagctaattcggcctacaaaggtttataactcaggaactttgtaggcctggtaagcgtagcgcagcaggcaattcgcctcgttttttatgcctgacgaattgcctgttcaacctcaaagcgattcgtcactttgctgtcgattttcacataagctgaatgttcttcttctgcaatcaacacttctttgacgccttcagtttccagcaaacgcacttttaacgcctcgtttgcggcaatgtccgccgggatttcaatgcgtaagctgctgacatacggcggttctttcatggtactggcgactgccagccacactgcggccagcattgcgccagcgagaaataccccctgaccgtcaaacatgccgtcaatccagccgcccagcgaaccgccaatcgccacgccaagaaactggctggtggagtaaacacccatcgccgtacctttgtaacctgctggcgactctttactgataagtgaaggcagaagggcttccatcaaattaaacgccacaaagaaaagctgcacgccgaccaccagttgccagaactgcgtttgtgcgttccacaacacaatttccgcaaccacgatcaacccgacgcagaagacaaagacttgcttcattttgcgcttaacttcagcgtagataatgaaaggcacgaccgagccaaaggcgattaacatcgttgccaggtagaccttccagtgttcagccgccggaaatcccgcatcagccagttgccctggcagggcaacaaacgtcgacatcagcaaaatatgcagacacataatgccaaagttgagtttcagcagccgcggttccgccagcactttactgaaactgcctttcaccattccggactcacgattaagtacgtgagtgctactgttgggcacaacccaaatggtcaacgcaatgccggttgttgccagaatagcgatcatccagaacagcgcgtgcagcccaagtttgtgagtgatgatcgggccaagcaccatcgcaatggcaaaggtaatgccaaagctcacgccgataaacgccattgctttggtgcggttttgttcgcgcgtgagatcggaaagcagcgccataacggcggcggcaatcgcaccagagccttgtaacgcccgacccagaataattccccagatggagtcggaaagcgcagcgataacgctaccaacagcaaacaccgccagtccgccgacaattaatggtttgcgaccaatgcggtcggaaagcagaccaaacggaatctgaaaaacggcctgcgtcagaccataaataccaatggcaataccgattaatgcttcgctggcaccttgcagagccatgccgtatgtggtcagaaccggcagaaccataaacatgcccagcatgcgcaacgagaatacggtccctaaaccccaggtcgcgcgccgctcacctggcgtcattttataatcgttcattaccacctctgttttaaattcgcgactagtgtaaagcggcaaacgaatggggtaaacatgcggattttttagtaaatatttcgagagggatatgtttctaatgctaagaaaaaaggtgccgtagcacctttttaactgagaggttgtattaccacacagcagccagcagcgtatgcgaatccggcaccataaaatcaacggacatcatcaccgagagggcagtgatggcgatgatagagaagccgaacagcttgcgcgcccagattctgtcatcagcaactttataaccgcgcagagccatgcctaaccaccagacgctcaccgccgcggcgactaccagatatttatacccagcgtaaccgccaagagagagcatcagcgtggcaacggcaaaggcgatgatatacagcgtgatgtgattcttcgccaccgaaatgccttttaccactggcaataccggaatgtttgccgcctggtaatccttaaagcggaaaatggcgatggcataggagtgaggcatctgccacagactgaagatagcaagcaggatcgctgcgccactatcgaactcgccggttactgcacagtagccgatcaccggcggcgcagcgccggagagcgaaccaatcaatgtgccgtagactgagtggcgtttcatgtacaggctataaacgccgacataaaccacaaagcccatcacccccagccagcaggccagcggattcgcgccaaaccacagcagcataaagccagcaatacccagcaaggtggcgtacaccagcgagacagcaggagagatcaggcctttaaccagcacccgattcttcgtcctttccatctttctgtcgatatccctgtcgatgtagttgttaaacacacaacccgacgccacaaccagtgacaccccaaccagcgtgtagataaacaggggataatcaatgcggccctttgaggccagcaggaatcccccaatcaccgagatcaggttgccaaagatgatgcctggtttcgttacttgcaggtattgcttaaacatcataaccgccgctcttagtgcatcatcatgttgtagttaaggttccacataatccagatggagcctacaaccaggatagcgatgattagcacggtgaagacaaacgccgtcatgttccagccttcatctgatttggtattcatgtgcaggaagcacaccagatgcaccagaacctgtaccactgccattgccaggattgttcccagaattacggccggagaggcagcccctgtcatcaccatccagaacggaatcaccgtcagaatgatcgacaggataaagcctgtcatgtaggtttttacgctgccatgggacgcgccgctgtgatcggtagaatgactcattacatcgcccccatcagataaacaacagtgaacacacagatccaaaccacatccaggaagtgccagaacaggctcaggcacatgatgcgggtacggttagtgctggtcaggccgcgacgagcgatttgtaccatcagcaccgccatccagataagaccggaagtgacgtgcagaccgtgcgtgccgaccagcgcaaagaacgctgacaggaagccgctgcgatccggacccatgccgttaacaatcaggtgatggaattcgtagatttccatcccgataaatccggcaccaaacaaccaggtcaacgccagccaggagataacctggcttttgttgtttttgtacatggcgatagccgccatgccgtaggtgatggagctgaacaacagcaagaaagtttcaaccagaacgaacggcagttcgaaaatgtccttacctgtcgggccgcctgcggtgccgttcaccagaacggcataggtagcaaacaagattgagaacagaatgcagtcgctcatcaggtagatccaaaatccgaagattttggttccgcctgcatcgtggtgcccgtgttcgtgcgcgtgggcagtcgcgtgcgtcaaagtatcagttgccatttttcagccctgccttagtaatctcatcgaaatgctggttttccagtttttcgatttctgccaccggcacgtagtaatccacgtcctcgtcgaagcttttcacgatccaggtgatgatcatgcctgcgaagccaacaatcgccagccaccagatatgccagatcatggcgaaaccgaagatggtggagaaagctgcaatgacgatacctgcaccgctgtttttcggcatatgaatttcttcatagtggtcaggctttttgtacgcttcgcctttctctttcatttcccagaatgcatcacgctcgtgaacgtgcggcacaacggcaaagttatagaacggaggcggggaagaggttgcccactccagcgtacggccaccccacgggtcgccagtcaggtcacggttctggtcgcggtcacgaatagaaacgtacatctgaataacgaggcagagaatacccagcgcaatcagtactgcaccgctggctgcaatcatcagcatggtgtggaactgcgggtcaatctgctggctcaaacgacgggtcatgcccatgaagcccagcgcatacagcggcataaaggcaacgaagaagccgatgatccagaaccagaacgcgcgtttaccccaggtttcgttcagtttgaaaccgaacgctttaggccaccagtaggtcatccctgcgaagcagccgaagaccacgccgccgatgatcacgttatggaagtgcgcaatcaggaacaggctgttatgcagaacgaagtccgcgcccggtactgccagcagcacgccagtcatcccgcccaccgagaaggtgacgataaaaccgatagtccacagcatcgcagaatggaacacgatgcggccctgatacatggtgaacagccagttgaagatcttcaccccggtcgggatggcgataatcatggtggtgataccaaagaaggcgtttacgttcgcgcccgcacccatcgtaaagaagtggtgcagccagacgatgaacgacagcacggtgatacagacggttgcccataccagcgaggtataaccaaacagacgtttacgcgagaaggttgccgcaatttcggagaacacaccgaatacaggcaggatcaggatgtaaacttccgggtggccccaggcccaaatcaggttgatgtacatcatcatgttgccacccatatcgttggtaaagaaatgggtgcccagatagcgatccagggtcaacaacgcgacggtaaccgtcagaattgggaaggaagcaataatcagaacgttcgcgcacagtgatgcccaggtaaatactggcatcttgaacatggtcatgcccggtgcgcgcatcttcagaatggtaacgaagaagttgataccggttagcgtcgtacctataccggatagctggagactccatatccagtaatcgacaccgactcccggactgtactctattcccgatagcggtggataggccagccagccggtctgcgcaaattcacccacgccgagagaaacgttaaccagaatcacaccaacaacggtaaaccagaagcttaggttgttgaggaacgggaacgcaacgtcacgcgcgccgatctgcagcggaaccaccaggttcatcagaccgataacgaaaggcatcgccacgaagaagatcataatcacgccgtgcgcggtgaagatctgatcgtagtggtgaggtggcaggaagcccgcttcgcccgcagaggcaagggcctgctggctacgcatcataatggcgtcagcaaaaccacgcagcaacatcacaatcgccacgatgatatacatgataccgaggcgtttatggtcgacggaggtcagccactctttccacaggtaggtccacttaccgaagtaagtgatcaggccaacgagcgccagacctcccaaaataatgccagcgatcgtaaccatgacgataggttcatggaacgggactgcatcaagtgataattttccgaacatctttattcttcctcaacccctttaatgggcggattccgcgtggctcatgtccatgccttccataccttcatgtgcgctgtgctcaccttctggctgggtcatgtccatgctcttaccgtgagccataaacttgttaatcacatcagcaaacaagtctggtttcacgttggagaaatattccacctggttgtactcgctaggcgcggccagtttttcgaacgctgccatgtcagacatggtgttcggcgactgtttcgcttttgcgacccactggtcgaatgcggcgcgatccggtgttgcaatagctttgaacttcatgcctgagaagcccgggccgctgtagctggcggagataccgtcataagtaccgggttcgttggcgatcagatgcaggcgagtctgcataccggccatggcataaatctggctacccagacgcggaatgaagaaggagttcatcacggagttggaggtcactttgaagtacaccggagtgttcgccgggaaagcgatttcattcacggtagcaatgccctgttccgggtagatgaagaaccatttccagtccatggaaaccacttcgatggtaatgggcttctcgtcgtgtgccagcggcttgctaggctcaagagcgtgagtggttttccaggtcagtaccgcaaggaagatgatgattaagataggtaccgtccagaccacagcttccactttattggagtgtgaccagttcgggctgtacttagcatctttattgctcgcacggtacttccaggcgaaaccaacagccatcaagattgcgggaataacgacaatcaacatcaggccaaatgccgtcagtatcagtgaacgttgctccagaccaatctgtcctttgggatctaacagcgcagaattacagccactgagcaatacagtgcctgcaaataatgacaaccatcccaaacttttattgtatttcctgagtctcatttaacgacctcaattccacgggatctggtggcgtttaaagtgtgtgggcattttacgggaaggttacattactgtaaacatgattaaattcctgttacttggatttggcttccaggtcacatatgttgcaaaacatatcaggttgattttaagaagctgttgcaaaagggcgttataacaaaaggggagtgcagaaggagtctgggcgggcaattggtataaccaatgcgaaataaaacaattatttaacaaataattatcattaaggtgacaactgggtagtgagaaaataaagactcattagctgaatcgtgtaagaaaaatagaattcataaatggcgtcaataatttccagacgctaagccgcacaaaagaacaaatattaataagcgatgctgatgtttatttggccgtaataattacggcgagtgattactacggctaaataatatttacagattacgtcagatgcgtttttcgtagcgccagataatccagtaaaccaccaagcacgacgccagaaagggcgactaaaaccccgacttccagcagagcaggcaggaaagagaagtgcgtcaaatccagcgcgtccatcgtcaacagcagtaaccacacggccaacaggctgacgcccgccgccagtgtccacatggcaaaggcataacctgcaggatattcggtacgggagataaagttgtcatttactcgtgtatattcaagcgtctggcggcaaaccagcagcaaaataagccctggtacggcagcggcgacggagaacagatagaatgtcgaccagccgtgtgcttcaacaaaccaacccgccacggggccgacataaactcgccctacagcagaaagcgctgagagcagggcaaattgagtagcggaaaatgacttattacacagcgtcattaacagcgcgacaaaggctgatgtacccatcccgccacagaggttttcgaaaaagacggctgcgcccatgctgtagagatgcttatcagtaatcgacagcagccagtaaccggcgttagacgcaccttgtaaaataccgaaaatcagcagcgcccggaacagtgacaggcgctgcatcaaaatcccaccgtacaatgcgccaacaatggtcgccagtaagccaagcgttttgttaaccacgcctacttcacccgcatcaaacccgacgccacgaatcaaaaacgtggttgtcaggctcatggcgaatgcgtcgcccagcttatacagcacgataagaagcaaaataagccaggcattattgcgaccaaagaaatcgcgcagaggtgcaacaaccgcttgttccagcgttttgggcacaggaatggtgtcggttggttctggtgcaagtaacgtcgcgataatacaggggatcaacagcgccgccatcaaccagtacatgccctgccagcccagccatttatctgccagccacagggctaagccgccggaaaccagcatccctaaacggtaacccagcacgctgattgccgcgcccgcaccacgttcttctgccgggagcacatcggttttccacgcatcgaagacaatatcctgggaggcagagcaaaaagcgatcaccactgccagtgccgccatccagcggagctgggtgccgggttcgagaaaacccatcgccgcaatggcgactaataacatgatttgcgtggcgagcagccaaccgcgccgccgcccaaaaaatgggggcgtgtagcggtccatcagcggtgaccagaggaatttaaaaacgtaagcctggcctaccagcgagaagaaaccaatggttttgaggtcgatattctcgaccgtcatccaggcctgtaaggtgccggatgtcagggcgagcggtagcccggaagcaaaacccaggatcagcaatatggctgaacgcggctgttgaaaaatacgtaaatattgactggacatgggcgtctacaggcccggcttgcaccgggccagagggcagaaattaacgcgcgttctgcttgatgaattcgtggatgctggtgtcctgagacatatcagcgatggtatcggtcagcacactgttaaccgcatcggcgatatttttgttggaggcctggaacgcaccttcaacgttgtagctggcacgatagttcttggtcattttgttgccattctgcgcggtagcgatgatggcaatatccgctttagtagcgatgttgtagcgcacgttgccctgggacacgtcagcatacagttggctaacgatgatttgcagattaaccgggccattcggaccaaccatgtaaccacgcgcggtcatctgtttttccagcacttcttgcagcaggaaacgcagatcgcgggaggcggtcagggtaacgatttgattatcgcgggtgacttttgccagcgcctgatcggtacgctgatcggcaccattaatgcttacggtgacgcccatcaggcttggatcctgctgtggcagtgtcatcgtcggggaaacttcaatagttgttggcggttttgcgcatcctgcaagcataaacagagcaactaacgggaagaggatttttttgaacatgttcgggctctcagagactcttaagcgtgtttggtaaaaattcccgccatcataacattgccaacggcgaggggaagtgggtaaggcatgtaaattcatcatgttgacgaaataatcgcccctggtaaaagaaacgctgatgcgaggcctgtgtttcaatctttaaatcagtaaacttcatacgcttgacagaaaaaccaggacgaaacctaaatatttgttgttaagctgcaatggaaacggtaaaagcggctagtatttaaagggatggatgacatctcagcgttgtcggaggagatatttcatgatgatacgtgagcggatagaagaaaaattaagggcggcgttccaacccgtattcctcgaagtagtggatgaaagctatcgtcacaatgtcccagccggctctgaaagccattttaaagttgtgctggtcagcgatcgttttacgggtgaacgttttctgaatcgtcatcgaatgatttacagtactttagcggaggaactctctactaccgttcatgcgctggctctgcatacttacactattaaggagtgggaagggttgcaggacaccgtctttgcctctcctccctgtcgtggagcaggaagcatcgcgtaaaaacgcatttgcaactgtcggcgcttttccagtatgttgctaaagattttatgaaaaacggcctgcgggccgttttgttttgtctggattttgcgctttttgcccagcattcagacgaaaattgcccgggaattgtgaaaaaatacgcgacagcgcgcaataaccgttctcgactcataaaagtgatgccgctataatgccgcgtcctatttgaatgctttcgggatgattctggtaacagggaatgtgattgattataagaacatcccggttccgcgaagccaacaacctgtgcttgcggggtaagagttgaccgagcactgtgattttttgaggtaacaagatgcaagtttcagttgaaaccactcaaggccttggccgccgtgtaacgattactatcgctgctgacagcatcgagaccgctgttaaaagcgagctggtcaacgttgcgaaaaaagtacgtattgacggcttccgcaaaggcaaagtgccaatgaatatcgttgctcagcgttatggcgcgtctgtacgccaggacgttctgggtgacctgatgagccgtaacttcattgacgccatcattaaagaaaaaatcaatccggctggcgcaccgacttatgttccgggcgaatacaagctgggtgaagacttcacctactctgtagagtttgaagtttatccggaagttgaactgcagggtctggaagcgatcgaagttgaaaaaccgatcgttgaagtgaccgacgctgacgttgacggcatgctggatactctgcgtaaacagcaggcgacctggaaagaaaaagacggcgctgttgaagcagaagaccgcgtaaccatcgacttcaccggttctgtagacggcgaagagtttgaaggcggtaaagcgtctgatttcgtactggcgatgggccagggtcgtatgatcccgggctttgaagacggtatcaaaggccacaaagctggcgaagagttcaccatcgacgtgaccttcccggaagaataccacgcagaaaacctgaaaggtaaagcagcgaaattcgctatcaacctgaagaaagttgaagagcgtgaactgccggaactgactgcagaattcatcaaacgtttcggcgttgaagatggttccgtagaaggtctgcgcgctgaagtgcgtaaaaacatggagcgcgagctgaagagcgccatccgtaaccgcgttaagtctcaggcgatcgaaggtctggtaaaagctaacgacatcgacgtaccggctgcgctgatcgacagtgaaatcgacgttctgcgtcgtcaggctgcacagcgtttcggtggcaacgaaaaacaagctctggaactgccgcgcgaactgttcgaagaacaggctaaacgtcgcgtagttgttggcctgctgctgggcgaagttatccgcaccaacgagctgaaagctgacgaagagcgcgtgaaaggcctgatcgaagagatggcttctgcgtacgaagatccgaaagaagttatcgagttctacagcaaaaacaaagaactgatggacaacatgcgcaatgttgctctggaagaacaggctgttgaggctgtactggcgaaagcgaaagtgactgaaaaagaaaccactttcaacgagctgatgaaccagcaggcgtaatttacgcagcataacgcgctaaattcgcacaaaggcccgtcaccgccaggtggtgggcttttttttgtcatgaattttgcatggaaccgtgcgaaaagcctctttcggtgttagcgtaacaacaaaagattgttatgcttgaaatatggtgatgccgtacccataacacagggactagctgataatccgtccataaggttacaatcggtacagcaggttttttcaattttatccaggagacggaaatgtcatacagcggcgaacgagataactttgcaccccatatggcgctggtgccgatggtcattgaacagacctcacgtggtgagcgctcttttgatatctattctcgtctacttaaggaacgcgtcatttttctgactggccaggttgaagaccacatggctaacctgattgtggcgcagatgctgttcctggaagcagaaaacccagaaaaagatatctatctgtacattaactctccaggcggggtgattactgccgggatgtctatctatgacaccatgcagtttatcaagcctgatgtcagcactatctgtatgggccaggcggcctcgatgggcgctttcttgctgactgcaggggcaaagggtaaacgtttctgcctgccgaattcgcgcgtgatgattcaccagccgttgggcggctaccagggccaggcgaccgatatcgaaattcatgcccgtgaaattctgaaagttaaagggcgcatgaatgaacttatggcgcttcatacgggtcaatcattagaacagattgaacgtgataccgagcgcgatcgcttcctttccgcccctgaagcggtggaatacggtctggtcgattcgattctgacccatcgtaattgatgccagaggcgcaactgtgccgctatacttatccagggcggcacaacgctgtaagcggcttgcgcctgagaatggcatttgcgtcgtcgtgtgcggcacaaagaacaaagaagaggttttgacccatgacagataaacgcaaagatggctcaggcaaattgctgtattgctctttttgcggcaaaagccagcatgaagtgcgcaagctgattgccggtccatccgtgtatatctgcgacgaatgtgttgatttatgtaacgacatcattcgcgaagagattaaagaagttgcaccgcatcgtgaacgcagtgcgctaccgacgccgcatgaaattcgtaaccacctggacgattacgttatcggccaggaacaggcgaaaaaagtgctggcggtcgcggtatacaaccactacaaacgtctgcgcaacggcgataccagcaatggtgtcgagttgggcaaaagtaacattctgctgatcggtccgaccggttccggtaaaacgctgctggctgaaacgctggcgcgcctgctggacgtcccgttcaccatggccgacgcaaccacgctgaccgaagccggttatgtgggcgaagacgttgaaaacatcattcagaagctgttgcaaaagtgcgattacgacgtacagaaagcgcagcgcgggattgtctacatcgatgaaatcgacaagatttctcgtaagtcagacaacccgtccattacccgagacgtttccggtgaaggcgtacagcaggcactgttgaaactgattgaaggtacggttgccgccgttccaccgcagggcgggcgtaaacacccgcagcaagagttcttgcaggtagatacctctaagatcctgtttatttgtggtggtgcgttcgctggtctggataaagtcatttcccatcgtgtagaaaccggctccggcattggttttggcgcgacggtaaaagcgaagtccgacaaagcaagcgaaggcgagctgctggcgcaggttgaaccggaagatctgatcaagtttggtctgatccctgagttcattggtcgtctgccggttgtagcaacgttgaatgaactgagcgaagaagctctgattcagatcctcaaagagccgaaaaacgccctgaccaagcagtatcaggcgctgtttaatctggaaggcgtggatctggaattccgtgacgaggcgctggatgctatcgctaagaaagcgatggcgcgtaaaaccggtgcccgtggcctgcgttccatcgtagaagccgcactgctcgataccatgtacgatctgccgtccatggaagacgtcgaaaaagtggttatcgacgaatcggtaattgatggtcaaagcaagccgttgctgatttatggcaagccggaagcgcaacaggcatctggtgaataattaaccattcccatacaattagttaaccaaaaaggggggattttatctcccctttaatttttcctctattctcggcgttgaatgtgggggaaacatccccatatactgacgtacatgttaatagatggcgtgaagcacagtcgtgtcatctgattacctggcggaaattaaactaagagagagctctatgaatcctgagcgttctgaacgcattgaaatccccgtattgccgctgcgcgatgtggtggtttatccgcacatggtcatccccttatttgtcgggcgggaaaaatctatccgttgtctggaagcggcgatggaccatgataaaaaaattatgctggtcgcgcagaaagaagcttcaacggatgagccgggtgtaaacgatcttttcaccgtcgggaccgtggcctctatattgcagatgctgaaactgccagacggcaccgtcaaagtgctggtcgaggggttacagcgcgcgcgtatttctgcgctctctgacaatggcgaacacttttctgcgaaggcggagtatctggagtcgccgaccattgatgagcgggaacaggaagtgctggtgcgtactgcaatcagccagttcgaaggctacatcaagctgaacaaaaaaatcccaccagaagtgctgacgtcgctgaatagcatcgacgacccggcgcgtctggcggataccattgctgcacatatgccgctgaaactggctgacaaacagtccgttctggagatgtccgacgttaacgaacgtctggaatatctgatggcaatgatggaatcggaaatcgatctgctgcaggttgagaaacgcattcgcaaccgcgttaaaaagcagatggagaaatcccagcgtgagtactatctgaacgagcaaatgaaagctattcagaaagaactcggtgaaatggacgacgcgccggacgaaaacgaagccctgaagcgcaaaattgacgcggcgaaaatgccgaaagaggcaaaagagaaagcggaagcagagttgcagaagctgaaaatgatgtctccgatgtcggcagaagcgaccgtagtgcgtggttatatcgactggatggtacaggtgccgtggaatgcgcgcagcaaggtcaaaaaagacctgcgtcaggcgcaggaaatccttgataccgaccattatggtctggagcgcgtgaaagatcgcatccttgagtatcttgcggttcaaagccgtgtcaacaaaatcaagggaccgatcctctgcctggtagggccgccgggggtaggtaaaacctctcttggtcagtccattgccaaagccaccgggcgtaaatatgtccgtatggcgctgggcggcgtgcgtgatgaagcggaaatccgtggtcaccgccgtacttacatcggttctatgccgggtaaactgatccagaaaatggcgaaagtgggcgtgaaaaacccgctgttcctgctcgatgagatcgacaaaatgtcttctgacatgcgtggcgatccggcctccgcactgcttgaagtgctggatccagagcagaacgtagcgttcagcgaccactacctggaagtggattacgatctcagcgacgtgatgtttgtcgcgacgtcgaactccatgaacattccggcaccgctgctggatcgtatggaagtgattcgcctctccggttataccgaagatgaaaaactgaacatcgccaaacgtcacctgttgccgaagcagattgaacgtaatgcactgaaaaaaggtgagctgaccgtcgacgatagcgccattatcggcattattcgttattacacccgtgaggcgggcgtgcgtggtctggagcgtgaaatctccaaactgtgtcgcaaagcggttaagcagttactgctcgataagtcattaaaacatatcgaaattaacggtgataacctgcatgactacctcggtgttcagcgtttcgactatggacgcgctgataacgaaaaccgtgtcggtcaggtaactggtctggcgtggacggaagtgggcggtgacttgctgaccattgaaaccgcgtgcgttccgggtaaaggcaaactgacctataccggatcgcttggcgaagtgatgcaggagtccattcaggcggcgttaacggtggttcgtgcgcgtgcggaaaaactggggatcaaccctgatttttacgaaaaacgcgacatccacgtccacgtaccggaaggtgcgacgccgaaagatggtccgagtgccggtattgctatgtgcaccgcgctggtttcttgcctgaccggtaacccggttcgtgccgatgtggcaatgaccggtgagatcactctgcgtggtcaggtactgccgatcggtggtttgaaagaaaaactactggcagcgcatcgtggcgggattaaaacagtgctaattccgttcgaaaataaacgcgatctggaagagattcctgacaacgtaattgccgatctggacattcatcctgtgaagcgcattgaggaagttctgactctggcgctgcaaaatgaaccgtctggcatgcaggttgtgactgcaaaatagtgacctcgcgcaaaatgcactaataaaaacagggctggcaggctaattcgggcttgccagcctttttttgtctcgctaagttagatggcggatcgggcttgcccttattaaggggtgttgtaaggggatggctggcctgatataactgctgcgcgttcgtaccttgaaggattcaagtgcgatataaattataaagaggaagagaagagtgaataaatctcaattgatcgacaagattgctgcaggggctgatatctctaaagctgcggctggccgtgcgttagatgctattattgcttccgtaactgaatctctgaaagaaggggatgatgtagcactggtaggttttggtacttttgccgttaaagagcgtgctgcccgtactggccgcaacccgcagaccggtaaagagatcaccatcgctgccgctaaagtaccgagcttccgtgcaggtaaagcactgaaagacgcggtaaactaagcgttgtccccagtggggatgtgacgaagttcaagggcgcatctactgatgtgccttttttatttgtattcggtgactttctgcgtcttgtgggctgacaattgcccccgtttcttgtcacaataggcctttgcgcgcatcgatacgttgcgtgaggtacacagtcatctacagcggagtgttgttacaccatgatggacagcttacgcacggctgcaaacagtctcgtgctcaagattattttcggtatcattatcgtgtcgttcatattgaccggcgtgagtggttacctgattggcggaggcaataactacgccgcaaaagtgaatgaccaggaaatcagccgtgggcagttcgagaatgccttcaacagcgagcgtaatcgcatgcagcaacagctgggcgatcaatactccgagctggcagcgaacgaaggctatatgaaaaccctgcgtcaacaggtgctgaatcgtctgatcgacgaggcgctgctggatcagtacgctcgtgagctgaaactgggtatcagcgatgagcaggttaaacaggcgatttttgcgaccccagccttccaggttgacggcaaatttgataacagtcgctataacggtatcctcaaccagatggggatgaccgccgatcagtacgcccaggcgctgcgtaaccagctcactacccaacagctgattaacggcgttgccggtaccgattttatgctgaaaggtgaaaccgacgagctggcggcactggtagctcaacaacgcgtggtgcgtgaagcgactatcgatgttaacgcgctggcggcgaagcagcctgtgaccgaacaggaaattgccagctactacgaacaaaacaaaaacaatttcatgacgccggaacaattccgcgtgagttacatcaagctggatgccgcaacgatgcagcaaccggttagcgatgcggatatccagagctactacgatcagcatcaggatcaattcacccagccgcagcgtacccgctacagcatcatccagaccaaaactgaagatgaagcgaaagcggtacttgatgagctgaataaaggcggtgattttgctgcattagccaaagaaaaatctgccgatattatctctgctcgtaacggcggcgatatgggttggttagaagatgccactatcccggacgaactgaaaaatgctggtctgaaagaaaaaggccaactgtctggtgtcatcaaatcttcggtcggtttcctgattgtacgtctggacgacattcagccagcgaaagtgaaatcgttagacgaagtacgtgacgacattgcggcgaaagtgaaacacgaaaaagccctcgatgcgtactatgcgctgcagcagaaagtgagcgatgcggcaagcaacgacaccgagtctctggccggtgcagagcaagcagccggcgttaaagccactcagacgggttggttcagcaaagataacctgccggaagagttgaacttcaagccagttgccgacgctatcttcaacggcggtctggtaggtgaaaacggcgcgccgggcatcaactctgacatcatcaccgtagacggcgaccgcgcattcgtgctgcgcatcagcgagcacaaaccggaagcggtgaaaccgttggcagatgttcaggaacaagttaaggcactggttcagcacaacaaagctgaacaacaggcgaaagtggatgctgagaaactgctggttgatttgaaagccggcaaaggtgcggaagctatgcaggctgccggtctgaaatttggcgagccgaaaaccttaagccgttccggtcgtgacccgattagccaggcggcgtttgcactaccactgccagcgaaagacaaaccgagctacggtatggcgaccgatatgcaaggtaatgtggttctgctggcgctggatgaagtgaaacaaggttcaatgccggaagatcagaaaaaagcgatggtgcagggtatcacccagaacaacgcacaaatcgtctttgaagcgctgatgagtaacctgcgtaaagaggcgaaaatcaaaattggcgatgcgctggaacagcaataatcctgaaggcgcctcgcaaaaaaatgctttgcagctgtaacaagaaaaggtcgctttcgcggccttttccatttctgaacattgccatttgtttcctgttttcactgccgttaaggtgtttccactgttaacaaacaaggagaaaacagtatgaaacacggaattaaagcactgctcattaccctgtctctggcttgtgccggaatgtctcatagcgcgctggcggcagctcctgcggcgaaaccgacaacggtagaaaccaaagcggaagctcctgcagcacaaagtaaagcagcagtaccggcgaaagccagtgacgaagaaggctcccgggtcagcattaataatgccagcgcggaagagttagcccgcgcgatgaatggcgttggcctgaagaaagcgcaggcgattgtcagttatcgcgaagagtacggtccgtttaaaacggtggaggatctaaagcaggtgccggggatgggcaattcgctggtggaacgtaatctggcggtattaaccctgtaattaatttgcatagtggcaattttttgccagactgaagaggtcataccagttatggcctctgtacttataacaacaacgtaaggttattgcgctatgcaaacacaaatcaaagttcgtggatatcatctcgatgtttaccagcacgttaacaacgctcgctaccttgagtttctcgaagaagcccgctgggatgggttggaaaatagcgacagttttcagtggatgacggcccataacatcgccttcgtcgtggtcaatatcaatattaactatcgtcgcccggcggtattaagcgacctgttaaccattaccagtcagttgcagcaattaaacggtaaaagcggcatcttaagccaggccattacactggagccggaagggcaggtggtagcggatgcgcttattacgtttgtttgtattgatcttaaaacgcagaaagcattagctctggaaggggaattgcgcgaaaagctggagcagatggttaagtaaacgttttgtggtgccggatgctcaagccgcatccggcgacacccggaataattacttcaacccggttttctgcttcatcgctgccatcaccgtcggtttatcggccagataatgattcaaaccgttggcgcgtaaattacacgccgcacaatgaccgcaaccgtcgcctttaatgccgttatagcaggtcaacgtttcgttacggactaaatctagtttgccgtaataatctgccagcgcccaggtttccgctttatcaatccacatcagcggagtttcaaaacgaatatctttcgccatgcctaaactgacggcatggtttagtgctttcacaaactcatcgcggcaatccgggtaaccggagaaatccgtttcgcagacgccggtaattacggcttctgcttttacctgatacgcatatattgccgccagtgtcaggaacaaaatattacgccctgggacaaacgtattcgggatgccatcagcttcaggttcataatcaggcaccggaatgctgtcacgtgtcaggctgctgaccgccagctcgttaagcagcgttacatcaagaaccttatgcgcgcgtgcccccagtttcagcgccagttcgcgtgccacgtcgatttctgcgcgatgccgctgaccgtaatcgaacgtcacgcaatggacttcatcatattgttgtaatgcctgcaccagacaggtggtggaatcctggcctccactgaacacaacgacagcacgtttcatagataatcctgcttgaacaataaaagcgttatggtaacgcctgcgattaacccggaccagctattcattgcgacggcgcgggaagccaggcttcggtaaattcaaaccagccgcgcggtgtcagtcgcacaccgttcacgccgggaggggcactaatgcgatagtgatagttgaatagcggcgtcagcgtcgcgtctgccattaactggctaaaaaccgcttttagggcattaaatcggttttcctcatcaggcattacttgcaccgcgtccagtgtcgattgcaaatgtgcatatgctggagcgtcgaaaacatgtggccatagtggatcgcaacgcagccattgctccagggtatattccggtgcttcgccaattaatctgtcgcccatcatgaggtctgcgtgtgccagtagggtcgtgtcgtcccagttttttgcgttatgaaaaataattgtgagttcacagccttccgctgccagtgtcgcctgtagacgttctgccatggtatgaagttctatcggtaggtgataaaccagtgtcaaggttttcggtagtttgacctcatccggtacttgccattgcggaatagtccagcctggcagtaatgcatgactggcggtgatcaggttttctccgacttctaacgtttgtaataaaccggattgatgaataatggagatcacttttcgcgcctgccagagggacagtcggggacttttgcgcaacgttaaatagcaaaaacctaaactgatgccactactgacctggctgacccgttgcaactcctccggtttgccgatagtgatttgcacgggatgccgacaactggttcccaaatctttttcgaaaagcggcggagttatccagtactcaaccgctttaagcagcggatgacgtaaatggtaataatcatgactctccaggcgcaccagttccactgtgaattgtgttaagcgaaaaggaccagtgccgatcagggggaattgcggatgcgccagatggctgcaatagctcgccagccggtgcgcaagccagtaatcggggcgatgtaaaaagaaggtcagacactgcggatgggtgacttcaatacgcttcacgctaataaataattgatccagtgctggcagttgtaacagcatcaataatcgctggtgtaagtgtgaggcttttactgcatcgccgttatgccagtgtagggttgaacgaagataaaagtcccagcgtaacccgtcagcagaggtttcccagtgatgcgctaaatcgccaatcgggcgctgggtattattatcgaagcgggtcaggccggaaaatatctgtccggcgagatgctgctcggcacggccgggcaaaaagcccggttgtagcggttcgagcgggcgatagtagggaatacgcaacgtgggcgtatcgttttgccattgtccgcccataaacggctgtaacagagtgcgcagctcacctggggccagttgcgccagctccagcacatcttgctgctttccggtttccagcgcctgttccatcatcgcattgcgtagcgattctggcgtgaccagaaagcgtagttgcccgcgctttccgcgtcctgactgcgcctgccactccagccatcccgcctcctgtgcctggcgtaacagcgtacgaacatggcgttcgctgcaaaaacagcgttcggccagttcgctgacggtgacggtttgcggctttccggcggaaggttgccacagacgttgatactggttaagacggttgagcagtcgcatataaacccggaacaatattatttaactattcactattacttccgtatatatcaggtgatactcaatcaccattaaccgtgtcacagagtggagaaagaaatggctcgtctggcagcatttgatatggatggcactttattgatgcctgaccatcatttaggtgagaaaaccctctctactttggcgcgactgcgtgaacgcgacattaccctcacttttgccacggggcgtcatgcgctggagatgcagcatattctcggggcgctatcgctggatgcatatttgattaccggcaacggaacgcgcgtgcattctctggaaggtgaacttttacatcgtgatgatttacctgcggatgtcgcggagctggtgctgtatcagcaatgggatacccgagccagcatgcatatcttcaatgacgacggttggtttaccgggaaagagatccctgcgttgttgcaggcatttgtctatagcggttttcgttatcagataatcgatgtcaaaaaaatgccactcggcagcgtcaccaagatctgcttctgtggcgatcacgacgatcttacacgcttgcagatccagctatacgaagcattaggcgagcgtgcacatttgtgtttttccgccacggattgcctcgaagtgctgccggtgggctgcaataaaggcgctgcattgacggtgctgacccaacatttaggtttatcgttgcgcgattgcatggcctttggtgatgcgatgaacgatcgcgaaatgttaggctgcgtcggtagcggatttattatgggcaatgcgatgccgcaattgcgcgcggagctcccgcatttaccggtgattggacattgccgaaatcaggctgtctctcactatttgacgcactggctggactatccacatctaccttattcccccgaataacgagatcccttccagcatcgggcaattgcccggttttttttgcgttgaatttgtcattttgtgccgtggtgtttaaaccgcacagaataaattgtcgcgatttcacctttaaaatagaattaaaagagaaaaaaattctccgtggaagggctatgttagataaaattgaccgtaagctgctggccttactacagcaggattgcaccctctctttgcaggcactggctgaagccgttaatctgacaaccaccccgtgctggaagcgtctgaaacggctggaggacgacggtatccttatcggcaaagtcgccctgctggatccggaaaaaataggcctcggcctgaccgcctttgtgctgataaaaacgcaacatcacagcagcgaatggtattgccgctttgtcacggtggttaccgaaatgccagaagtgctggggttctggcgcatggccggtgaatacgattatctgatgcgcgtccaggttgccgacatgaaacgctacgacgagttttataagcgtctggtaaacagcgtgccggggctgtcggacgtcacttccagcttcgcgatggaacagattaaatacaccacttctttacccatcgaataaatatccagaatcaggtcaggacacaacgcgtgcgattatttgctcaattaagctggtatttccgtcgggaatggcgtcgctatctcggggctgtcgccttgcttgtcattatcgcgatgctgcaactggttccgccaaaagtggttggtattgttgtcgatggcgtgacagaacaacactttactaccgggcagatcctgatgtggatcgccaccatggtgctgattgccgttgtggtttatctcctgcgttacgtctggcgcgtattgctgtttggtgcgtcttatcaactggctgttgaactgcgtgaagattattaccgccagctaagccggcagcatcctgagttttacctgcgtcatcgcacgggtgacctcatggctcgtgcgaccaatgacgtcgatcgcgtcgtgtttgccgccggagaaggggtgctgacgctggtggattcactggtaatgggctgcgctgtgttgattatgatgtctacgcaaattagctggcagttgaccttatttgccctgttgccgatgccagtgatggcgatcatgattaagcgcaacggcgatgccttgcatgaacgctttaagctggcgcaggcggcgttttccagtcttaatgaccgcacccaggaaagcctcaccagtatccgcatgatcaaagcttttggtctggaagatcgccagtcggcgttatttgccgcggatgccgaagataccggcaaaaaaaacatgcgggtggcgcgtattgatgctcgtttcgacccgaccatctatatcgcgattggtatggcgaacttgctggcgattggcggcggtagttggatggtggtgcagggtagtttaacgctgggccagctcaccagttttatgatgtatttaggtctgatgatttggccaatgctggcgctggcatggatgtttaacatagtggaacgtggtagtgctgcgtacagccgcattcgcgcgatgctggcggaagcgccggtggtgaatgatggtagcgaacccgtgccggaaggtcgtggcgaactggatgtaaatattcgccagttcacgtatccgcagactgaccatcctgcgctggaaaacgtcaatttcgccctgaaacccggtcagatgctgggtatctgcgggccgactggttccggcaaaagtaccctgttgtcgctcatccagcgtcatttcgacgtcagcgagggtaatattcgctttcatgatattcctctgacgcagttgcaactcgatagctggcgtagccgcctggcggtagttagccagacaccgttccttttttctgacaccgtagcgaacaacatcgcgttgggttgcccgaatgccacccagcaagagattgagcatgtcgcgcggttagccagcgtgcatgacgatattttgcgtttaccgcaaggttacgatacagaagtgggcgagcgcggcgtgatgctttccggtgggcaaaaacagcgtatctccattgctcgtgcgttattagtcaacgcggaaatcctcatccttgatgatgcgctttcggcagtggacggacgcacagagcaccagatcctgcataacctgcggcagtgggggcagggaagaacggtaatcatcagtgcccatcgcctttcggcactgacggaagccagtgaaattattgtgatgcagcacggacatatcgctcagcgtggcaatcatgatgagctggcgcaacaaagcggctggtatcgcgatatgtatcgctatcaacaactggaggcggcgctcgacgacgctccggaaattcgcgaggaggccgttgatgcgtagttttagccaactgtggccgactctcaagcgtctgttagcgtacggttcaccgtggcgtaaaccgttggggattgcggtcctgatgatgtgggttgcggcggcggcagaagtcagtgggccgctgcttatcagctattttatcgacaatatggtagcgaaaaataacctgccgttgaaagtggttgcagggctggcggcggcgtatgttgggctgcaactgtttgcagccgggctacattacgcgcagtcgctgctgtttaatcgggcggcagtaggcgtagtgcaacagttgcgtaccgacgtgatggatgctgcgttacgccagccattaagcgagtttgatacccaacctgtcgggcaggtgatttcccgcgtcactaatgatactgaagtgatccgcgacctctacgttaccgtagtggcaacggtcctgcgtagcgccgccctggtgggtgcgatgctggtggcgatgtttagtctcgactggcgaatggcgctggtggcgataatgattttcccggtggtgctggtggtaatggtgatataccagcgttacagcacgccaattgtccgtcgtgtgcgcgcctatctggcggatattaacgacggctttaacgaaatcatcaatggcatgagcgtcatccagcagttccgtcagcaggcgcgatttggcgaacgtatgggtgaggccagtcgttcacactatatggcgaggatgcaaaccctgcgcctcgacggttttctgctgcgtccgctgctgagtctgttttcatcgctcattctttgtggattgttgatgctgtttggcttctccgccagcggtaccattgaagtgggcgtactgtatgcgtttatcagctatcttgggcggcttaacgaacccttaatcgaactgaccacgcaacaggcgatgctgcaacaggctgttgttgctggtgagcgcgtgtttgagctgatggacggaccgcgccagcaatatggcaatgatgatcgcccgttacagagtggcaccatcgaagtcgataacgtgtcatttgcttatcgcgatgacaatctggtgctaaagaacattaatctctctgtgccttcgcgcaattttgtggcgctggtcgggcataccggcagtggtaaaagtaccctcgccagtttattgatgggctattacccgctaacggaaggtgagattcgccttgatggtcgtccattaagttcgctaagtcacagcgcgctgcgccagggcgtggcaatggtgcagcaagatccggtggtgctggcggataccttcctcgccaacgtgacgctggggcgtgatatctccgaagaacgcgtctggcaggcgctggaaaccgtgcaactggcggagctggcacgcagtatgagcgacgggatttatacgccgctgggcgagcagggaaataatctctcagtcgggcaaaagcaactgctggcactggcacgcgtgttggtggagacgccgcaaatcctgatccttgatgaggcaaccgccagcattgactccggtactgaacaggcgattcaacatgctctggcggcagtgcgtgaacataccacgctggtggtgattgctcaccgcttatcaactattgttgatgccgacaccattctggtgcttcatcgtgggcaagctgtggagcagggcactcaccagcaactgctggcggcccagggacgctactggcagatgtatcaactgcaacttgcgggcgaagagctggcagccagcgtgcgtgaagaggaatcattgagcgcctgaatagcgcaatatttcatcgttggtgcaaaaatgtaacgcactgtgcactgtcatagtgcgttttcattttcaatcttcttaacttcctgctctctttctcatttttcatttctggcacaccgcttgcaatatcttcttcgtgtagcagaaccattaccgaattctgaccggaggggatctatgaagctggtgaccgtgataatcaaaccattcaagctggaagacgttcgtgaagcgttatcttccattggtattcagggcctgaccgtcaccgaagtgaaaggtttcgggcgtcagaaagggcatgccgagctgtaccggggggcggaatacagcgtcaactttctgccaaaagtaaaaattgatgtggcgattgctgatgaccaactcgatgaagtgatcgatatcgtcagtaaggcggcttacaccggaaaaattggcgacggcaaaatctttgtcgctgaattgcaacgcgtcattcgtattcgtaccggcgaagccgacgaagcggcgctgtaatctctggcacacagcaacaggaacgaaaaatgaagatagcgacgataaaaactgggcttgcttcactggcgatgctgccgggactggtaatggctgcacctgcggtggccgataaagccgacaatgcgtttatgatgatctgtactgcgctggtgctgtttatgactattccggggattgccctgttttacggtgggttgattcgcggcaaaaacgtgctgtcgatgctgacgcaggtgacggtgacgtttgcactggtctgtattctctgggtggtttacggttactcgctggcgtttggtgagggcaacaacttcttcggcaacattaactggctgatgctgaaaaacatcgaactgacggcggtgatgggcagcatttatcagtatatccacgtagcgtttcagggatcgtttgcctgcattaccgtaggcttgatagttggggcgctggcggaacgaatccgcttctcagctgtgttgattttcgtggtggtatggctgacgctctcctacattccgattgcgcatatggtgtggggcggtggtttgctggcttctcacggtgcgctggatttcgcgggtggcacggtggtgcacattaacgccgcaatcgccggtctggtgggcgcatatctgataggcaaacgcgtgggcttcggcaaagaggcgtttaaaccgcacaacctgccgatggtcttcaccgggactgccattctctatatcggttggtttggctttaatgccgggtcagcgggcacggcgaatgaaatcgcagcactggcatttgtgaatactgtggtcgcaacggcggcggcaattcttggctggatcttcggtgaatgggcgctgcgtggtaagccttcactgctgggagcgtgttcaggcgcgattgccggtctggtcggcgtgacgccagcctgtggctacattggggttggcggcgcgttgattatcggcgtggtagctggtctggcgggcttgtggggcgttaccatgctcaaacgcttgctgcgggtggatgatccctgcgatgtcttcggtgtgcacggcgtttgtggcattgtcggctgtatcatgaccgggatttttgctgccagctcgctgggcggcgtgggcttcgctgaaggtgtgacgatgggccatcagttgctggtacagctggaaagcatcgccattacgatcgtctggtccggtgtggtggcatttattggctacaaactggcggatctgacggttggtctgcgtgtgccggaagaacaagagcgagaagggctggacgtcaacagccacggcgagaatgcctataacgcgtaacaagcactgcaaaaaacagccggacggttttcacctccggctatttttttaattgtgattacgcattaccccttcctgaacggtcgaggcaaccagcacgccgtcctgagtataaaactcaccgcgcacaaagccgcgtgcgctggacgccgaggtgctctccacgctatacagcagccattcattcaaattaaacgggcgatggaaccacatggaatggtcaatggtggcaatctgaatccccggttcgagaaaaccgatgccgtgcggctgtagagctaccggcaggaagttaagatcagaagcgtaaccgagcagatactgatgaacgcgcagatcatccggcacgctaccatttgcgcggatccacacctgacgatgcggttctgcgacgtgccctttcagtgggttatgaaactccaccggacggacttcaagcggacgatcgcagatgaatttatctttcagcactggcggcagcaggtgcgccagcgattgggcgatttgcgtttccgaaggcaggccatcaggcgctggcgcggacggcattgttttttgatgttcgaaacccgcttctggtgcctggaaagaggcagtcatataaaaaatcggtttgccgttttgaatagcagcaacccggcgggcgctgaagctgttaccgtcacgcagcgtttcgacatcataaataatcggtttcttactatcgcctgggcgaagaaagtagctgtgaaacgaatgtaccagccgctcttcagggacggtctcttttgcagcatacaaggcctgacccacgacctggccgccaaacacctggcgtaaacctaaatcttcactctggccgcgaaagagtccttcctcaattttttccagatttaacaatgtcagtaaattttttagcgcctgactcatataactctccagtaacaaagctgccgcagcaagccaaagtgagttgagtataacgcaaatttgccactggtccgatgggtgcaatggtctgaattacgggctaattacaggcagaaatgcgtgatgtgtgccacacttgttgacgttactattttgttaaccactcttccggcgaggaaagttagcccgctggtgcattgataataaggagaagtgaatgaaactcgtgcacatggccagtggtttagcggttgcgattgcgttggcggcttgcgcagataaaagcgcggatattcagacgccagcaccggctgcaaatacgtctatttcagcaacacaacaacctgctatccagcaaccgaatgtctccggtaccgtctggatccgtcagaaagtcgcactgccgcctgatgctgtgctgaccgtgacactttctgacgcgtcgttagccgatgcaccgtcaaaagtactggcgcagaaagcggtgcgtaccgaaggcaaacagtcaccattcagctttgttctgccatttaacccggcagatgttcagccgaatgcgcgtattctgttgagtgcggcgattaccgtgaatgacaaactggtatttattaccgataccgttcagccggtgatcaacaagggcggaactaaagccgacctgacattggtgccggtgcagcaaaccgccgtgccggttcaggccagcggtggcgcaacgactactgtaccttcgacttcaccaactcaggtgaatccgtcttcggcagttccagctcctacgcaatattaagcgcagttaaccctctccgcccggagagggttagtagttccagcgataacgctgcaagtcgatttgcccgcttcccgataccatcacaccttctgccagtaatgcctgtcgttgacgctgtaaatccggtccggttagcgaaattgtgccgtggcgattaaccacccgatgccagggcaaggtgctgccttcagggagacgctttaacacaccgcccacctggcgcgcggcgcggggcgatcctgccagtttcgccacatcaccgtaagtggtgacatagccttcgggaatagcggcgacgatttgccagacgcgttggggaaatgaatcttctttttccatcttttcttcctgaggtaatttttcagcataatctggaaaaacgcccgagtgaagtcgcattgcgcaagaaaccagcatccggtacgcaatgggttgcaattagccggggcagcagtgataatgcgcctgcgcgttggttctcaacgctctcaatgggggctctgttggttctcccgcaacgctactctgtttaccaggtcaggtccggaaggaagcagccaaggcagatgacgcgtgtgccgggatgtagctggcagggcccccacccatttctgcctccccccgtttcgtcaaaaaatcccaatatggctaaactttaaccacaactgacgtcgcaagaattgtctggctgcgcagtacgcttcggaggtatgtctgatgaagtatgttgatggttttgtggttgccgttcctgccgataaaaaggatgcctatcgggaaatggctgctaaggctgcgccattgtttaaagagtttggcgcgcttcgtattgtcgaatgctgggccagcgatgtaccggatggcaaagtgaccgattttcgtatggcggtaaaagctgaagagaatgaagaggttgtctttagctggattgaatacccttcaaaagaggtccgcgacgctgctaatcaaaagatgatgtcggacccacggatgaaagagttcggcgagtccatgccgtttgatggtaagcgaatgatctatggcggattcgagtcaatcatcgacgaataggtagcgtgacgggctgtgcggcgtgccgtcagccctacaattcacaaatgttgctcggcccagcgtaagaaatcttctttcggtaatgccttgctgtagagccagccctgaccgtagtgcacgccatgctggcgtaaccactcttcttgtttactggtttcgattccctccgctaccattttcagtttcagtgtttttgccatttcgatgatatgcggcgtgacatttttatattccagcgcatcaacgaaagatttatcgatcttcagaatgtcgacatccagatcctgtaaataacttaaacttgaataccccgtaccaaaatcatcgagataaatttcatggcccgcctcccggtagcgagaaattatcggggcgctggttttcggatcggcaaactcgcgttcagtgagttcaagcgcgatctgtctgggattaacctgatagtgattgatcatttcacgcagcaattgcgggattttttccgaggtgagcacggtggattcaagattgatcgaaatatgctgctgcggatgctgacgcagccagtcgcccatatcttcgaagacgcttcttataatcagtagcgtcaacggctcagaaaggcccgtttgctgtgccagtggaataaaactatctggtgacaaccaactaccgtctgtctgcggccagcgcgccagtgcctcagcaccgacaattttgccattggctaaggagacaatcggctgatagtgcacgcaaatatcacgattttcgatagcatcctgcagccgatgatgcggtgactggatacggcgcaaaatacgcagcacaaacatcgctgccagcaggccaatcaccaacccgagcggtaaccaaataaagacttgccgatgccagcctttctgcaacattttcgttgaagcccaggtgatgatcgaaatattcatttccgggaagggcaggatatcgtaaatgattccattattttcgatatgctcaccgggtgttttttgtagtctggtaataattccctgagcaatttcatcgctgctggttatcacaacgttatgggcattgccaataatggcggcatcaatttgccatgagctatagggaatgacatcaataaaggaagcggggtcgatcatgacgacataatgtgccgttcccatggcaaccatgtaacggataatgcctaaatcgttatgcgatgttaaccagacacgataaccatctttcgaaattttacctggctcggggaaggtatcgggcgggctttcatgctccagagacgaacactggggaacgttgttatcgatataaaccacttcctgaatatagcgataactgtaagatacccgacgcatttccatgagatgggcttcgctacaggtagcgccttgccatctttccagctcttgcagcgcatctttcccttgtgtcgccaccttattggcccgaatagcgacgcgggaggaatacgtattcagctcttcaataaatgatgtttctacctgctgatgggccagccagatgcttaagccgacaggcagcaatactgaaagaatcagtactcccgaaataaggccgaccagatgtcgtgttctcaccagcatatccttattaacacagtgtagggaaagtatatctgattgtggaaaaaggctggcaggagataaggaggtagagccgggatttcatgaagggatgggtggaaacgaacgttgtcatttgaccaggcgcagagctttacgcctggtatgtaaccctaacttaagatgttgattcggcgcgagcgagggtaaaaatatcgtaaaaagacagttcacctttacggacgatcattttttgcagttgttctttatgaacatccgcgacacgcggagagttcaagatggcttcaaccagcgcggcaggtacaaagcgcgtgttgtaccattcgccgttatagcaaacgcggaaatccagcacgtcgatatcttcatagcggtagcgtgggtagacatcgaaaaagaagaaaccattaagcaggataaataatacaaccagtagccagacagagcctgacagcgtttcggactgcaacatcactgccagggtggcaaaaaaagcaacgtacataccgataaacagccccggatgtttacggataaaactgatactaaagcggggtttgttgtcgcgtttttcgcgggtatttagagactcaattgtttcggtcagcaggcgttgtatttcggtcatcgtttgccttcgtggtatctgcaactttccagggaacaccctattttaacgtgggaatagtagaggggaagtaacagatttaccacaattttgcataacagttgcgaaaaacatattacaattttttaattattctggctggattaccgcccacgacaacgttgtccgggacatcttttgtgacaactgcacctgaggctaccacgacgttatcaccaatggtcacaccagggttaatgaccgcgcgtccgccaatccagacgttattaccgatggtgacgggtatccccagttcagcaccgctattacgtgctacagggtcgatgggatgtgttgccgtgtagatatgaacgcctggtgccaacatacagttatcaccgatgcgaatagggcagacatcaagcatcacgcaatcgaagttggcgaaaaaattattgccgagaaaaatattatagccataatcacagcgaaacgttggctcaatataagcctctgtcacctgaccgaataaatcagcgagaatttgctggcgtaatgtgtgctcttccgccagggaatgattgtatcggtgaataagctgacgagcgcgcaggcgatcgcgagataacgtctcatctgccgagcgatacaactcaccagcaatcatcttttctttttctgtgctcattactgacctccggttgctgaaaatgcggcaacacagtaagacgaaaagtcagtgaagagaacgttcccattacatctgtgtgataaagatcacatagggtacgtcttcatggcgaaaaagtataaaattcttaataaacagccggttatagctccgaaagcgaattatttattagcgaataaatttccatactgaggaagggatcttgtcgtacagtttattcatggtcaattcggcgaggcggtgatctgcggctgagtaaaataccgccagttcattatctgataattcgtatttatttttctcgataacacgctccagcgtgtcaattgtctggcaacgacgtaaacgcattaaataatcggtttttgttaaaggtttttcggacatacttctacccatggttgtaataattctaacaagataaactcgcaggattctctttcgtcgcattgacaaaacaacggaatagtcgattacctgacttccgccatttctgaagatcctgcatattaataccataactgctgaacaacataaaggtgtcatccagatattcgtcgatctgctcaatgagcttattgtcttcattatacttaattttgtaattaagtgcgaaggtcgcaatatgctcaatcagttcattcaactggaggttgatcgccgaggttgggtcgttaacccagccatgattgctttcttcaaggtttgcaagacagtcatgatacagggtttcacagagaaacttaagctgtgcgatatcatgtcttttgggtgagtattcatccataacgcgtccccttcttagtggttgaactaacggacacctttcgggatggaaaaaacttactgacctggacttgccctctcgtttgttagcttaactataagccactctttgcaggttttcatcgcattattacgaaaaattacaattaggaaggaagcgggacaggacttactttttcatactagcactaacccgcagcaggtaaaagcagtttgctcgaactgttcataacatttcaggattatcgccagatgaaattggtaacactaataccaggattgctctgaatatgacgtaataaccgaggaatgaataaagaattaccgcaaataattaagaatagcctctaaatgattatggattattaaatctattagcgctacttaatataaattaactaacaatcagtattttttatgaattttatacgtgtttaatactggttttcgtatgagatcctgagttggtggttcaatgactccttaatgttcgtcggttatgcataaaaaaggccgcttgcgcggccttagtgattacacgttgtatcaatgatgatcgacagtatggctgtgctcgatatcttcattcttgcggctaaagcggcggcgaaccaccacaaagaataccggaacgaagaagattgccagtaccgttgcggtcaccatcccgcccattacaccggtacctactgcgttctgcgcgccggaaccagcaccagtactgataaccagcggcataacgccgaggataaacgccagcgaggtcatcaggatcggacgtaaacgcatccgcaccgcatcaagcgtcgcttcaatcagacctttaccttctttatccatcaagtctttggcgaattcgacgataagtatcgcgttcttcgccgacaacccaatggttgtgagcaggcctacctggaagtaaacgtcattggtcaggccacggaaggtggcagccagcaacgcaccgataacccccagcggaacgaccagcataacggagaacggaatcgaccagctttcatacagcgccgccagacacaggaacacgacaatcaacgaaatcgcgtacagtgaaggtgcctggttgccggagagacgttcctgataggacatccccgtccagtcatagccaacaccggtaggcagtttgctcgccagttgttccatcagctccattgcttcaccggtacttttacccggtgccgcctggcctaagatttccatggatggcaggccgttgtaacgttccagacgcggcgaaccgtactcccaacgagaagaggagaacgccgagaacggcaccatctgaccatcagcagcacgaacataccagtcgccgatatcatccggcagcatacggtatttcgcttctgacatgacgtaaactttcttcacacgaccgcggtcgataaagtcgttcacatagctaccgccccatgcagcgcccagagtggtgttaatgtcgttgatagaaacacccagcgcctgcgctttttcctggtcgatatcaatcttaaactgcggggtatcttccagaccgtttggacgtacgctggtcaacatatcagggtgcttcgctgcttctgcaagcagctggttacgcgcctgagtcagtttttcgtgaccaaggccagcctggtcaatcagctcaaagtcaaagccggttgcagtacccagttccacgattgcgggcaggttaaaggcgaaaaccatcgcatctttgatttgcgagaaagcgcgtgttgcacgcatggtaatcgcttcaactttgttttcttcacccggacgatcggcccagtccttcaaggaaacgaacgcaataccggtattctgaccacgtcccgcaaagccgaagccgttaacggcgaacaccgactcaacgttgttcttttctttggtcagatagtaattcgttacctcattgagcactttctgcgtacgttcctgcgttgcacctgctggcagctgaaccatggtcataaatacgccctggtcttcatctggcaagaaggagcttggcagacgcacgaacagataggccatgccgaccacgatgatcagatacagcaccaggtaacgccctgtactgcgcagaataccgcctacgctgtcggtgtagtggtgcgtgctcttctcgaacatgcggttaaaccagccgaagaagccttttttaccttccccgtgatcgcctttggcaatcggtttcagcatggtggcacaaagagccggggtcagaatcaacgccaccagtaccgacagcgccattgctgaaacaatggtaatagagaactgacgatagatagcaccagtagaaccgccaaagaaggccatcggtacgaataccgccgacagtaccatcgcgataccgaccagagcgccctgaatctgccccatcgacttacgggtggcttcttttggcggcaaaccttcttccgccataacacgctcaacgttttctaccacaacgatggcgtcatccaccaacaggccgatggcgagcaccatcccgaacattgttagcgtgtttatcgagaagccaaaggcggcaaggacggcaaaggtccccagcaataccaccggtacggcaatggtcggaatcaacgtcgcgcggaagttctgcaggaacagatacataaccaggaacacgaggatgatcgcttcgaccagcgttttaaccacttcgtgaatagagattttcacgaacggcgtggtgtcgtacgggtaaacaattttcagacccgacgggaagaacggttccatcttcgccagttcagcacggattgccgcagcggtatccagcgcgtttgcaccggtcgccagcttgatccccagaccggaagccggttggccgttaaactctgcgatgatgtcgtagttctcaccacccagctcaattttcgccacatcacgcagcagcacgcgggaaccatcctgattcactttcagcaggattttgccaaactcttcagtagaggtcagacgcgtctgagcaataatagaggcgttaagctgttggcctttcaccggcggcgtaccaccgagctgaccagctgcaacctgggcgttctgcgctttgatggcggtaatgacatcaaccggtgttagctggaatttgtttagttcattcgggttcatccagatacgcatcgcgtactgtgaaccgaacaactgaacgtcacccacgcccgacgtacggctgatggcatctttcatatttgccgctacgtagtcagagatatcctcctgcgtcatggtgccatcggtgttgataacgccgacaaccatcaggaagctgctggatgatttctcaacgctcaccccttgctgctgaacttcttgcggcagcaacggcatcgccagctgcagtttgttctgcacctgaacctgcgcgatatccgcatcagtaccagactcaaaggtcagggtgatctgcacggtacccgtggagtcactgttagaggacatgtacatcaggttatcgataccgttcatattctgttcgataacctgtgtcaccgtgtcctgcactgttttcgcatcagcgccggggtaggaggcggagatcgttactgccggcggtgcaatcgtaggatattgcgccaccggcagtttgaggatcgccagcccccctgccaacatgatgataatggcgatcacccacgcaaaaatcgggcgatcgataaagaaattaggcatgtcttaacggctcctgtttaagttaagacttggactgttcaggctgagcaccgcttgcggcttgctggttattatcagcggtaacttcttgtgcttttacctggacaccaggacgcactttctgcagcccacttattactacgcgatcgcctgctttcagaccttctgtcaccagccacttatcgccaatagcctggcttgcaacgatcggacgggtttccactttgtcatccgcgccaaccaccagtacggtggcatcgccacgcggcgtacgggttacgccctgttgcgggactaaaatagcgtttggattaagcccttcttccagacgtgcacgtacgaacatacccggcagcagagtgtgatccgggttcgggaagatagcgcgtagggtgatagacccggtggtctgatcaacggtaacgtcagagaattccagcgtaccgtcctgcgggaacttaatgccgtcactggtgatcagcgacactttggctttgccgttctcttgtttcagcgtgccatttgccagttcctgtttcaggcgcaggaagtcgttgctggactgggtcacatcaacgtagatcggatcaagttgctgcacggttgccagcgcagtcgcctgaccgttctgtaccaatgcgccttccgtcacgttcgacttaccaatgcgaccgctaatcggagaggtaactttggtgtaagccagattgatccgcgcagtttcaacggcagctttcgccgcagttaccgcagcatttgcctgttgcgcatcagccagagcctgatcgtactcttgcttactgatgtactgagtaccgagcaatttctgataacgattcaccgtcaattgcgcgatattggctgcagcctgggctttcgccagatcgcctttcgcgctgtcgtatgccgcctgataggtcgcaggatcaatctgatagagagagacacctgcttcgatgtcgctaccttctttgaaattacgcttcaggataatcccgctaacttgaggacgaacttctgcgatccggtaggcactggtgcgacccggaagctcggttgtgatctgcagaggttcagttttgactgttactacgccaacggcgggcatctgctggccaccttgttgggcctgtttgtcgtcacatcctgttagggctaagctgcctgagagcatcagaacgaccgccagaggcgtaaaccctctgtttttgttcatatgtaaacctcgagtgtccgatttcaaattggtcaatggtcaaaagttaataaacccattgctgcgtttatattatcgtcgtgctatggtacatacattcacaaatgtatgtaaatctaacgcctgtaaattcacgaacatatggcacgaaaaaccaaacaagaagcgcaagaaacgcgccaacacatcctcgatgtggctctacgtcttttctcacagcagggggtatcatccacctcgctgggcgagattgcaaaagcagctggcgttacgcgcggtgcaatctactggcattttaaagacaagtcggatttgttcagtgagatctgggaactgtcagaatccaatattggtgaactagagcttgagtatcaggcaaaattccctggcgatccactctcagtattaagagagatattaattcatgttcttgaatccacggtgacagaagaacggcgtcgattattgatggagattatattccacaaatgcgaatttgtcggagaaatggctgttgtgcaacaggcacaacgtaatctctgtctggaaagttatgaccgtatagaacaaacgttaaaacattgtattgaagcgaaaatgttgcctgcggatttaatgacgcgtcgggcagcaattattatgcgcggctatatttccggcctgatggaaaactggctctttgccccgcaatcttttgatcttaaaaaagaagcccgcgattacgtcgccatcttactggagatgtatctcctgtgtcccacgcttcgtaaccctgccattaccgaataaccctgaatctgactccaggatttttcctggacattttcgtcgttgctattctggttcactgcgtcgtgatattcttgcggtttgactttttcaggtcgttcttcaggttcagaaaccttcattcatcatgactatgttccagtattacaaacgatcacggcattttgttttttcagcatttattgcttttgtttttgtcttgttatgccagaacacggcgtttgcgcgggcgtcatcgaatggtgatctgccgacaaaagcggacctgcaggcacaacttgactcactgaataaacaaaaagatctttctgctcaggacaaactggtgcagcaggatctgacagatacattagctaccctcgataaaatcgatcgcgtaaaagaagagacagttcagctacggcaaaaagtcgctgaagcgccggaaaaaatgcgccaggcgaccgcggcgttaactgcacttagcgatgtcgataatgacgaagaaacgcgcaaaattctgagcacactttcgttgcgccagctggaaactcgcgttgcccaggcgctggacgatttgcaaaacgcacaaaacgatctggcgtcttataacagccagctggtttcgttacagacgcagcccgaacgcgtgcaaaatgcgatgtataacgcttcgcagcagctgcaacaaattcgcagtcgtctggatgggactgatgtcggcgagactgccttacgtcccagccagaaagtgttaatgcaggcccagcaggcgttgctgaatgcggagattgaccagcagcgtaaaagcctggaagggaacaccgtcttgcaggataccttgcaaaagcaacgggattacgtgacggcgaacagcgcccgtctggagcaccagttgcagctgttgcaagaagcagtaaacagcaagcgcctgactttaaccgaaaaaacggcgcaggaagccgtctccccggatgaagccgcgcgtattcaggctaatccgctggtgaagcaggaactggaaattaaccagcagttaagtcagcgtctgattacagcgactgaaaacggtaatcagttgatgcagcaaaacattaaagtcaaaaactggctggagcgggcgcttcaatcggaacgcaatattaaagagcagattgccgtcctgaagggcagcctgctgttgtctcgtatcctttaccagcaacaacaaacgctgccctcggcggatgaactggaaaacatgaccaaccgcatcgcggatttgcgtctcgaacagtttgaagttaaccagcagcgtgatgcactcttccagagcgatgcgttcgtcaacaaactggaagaaggtcacaccaacgaagtcaacagcgaagttcacgatgcgttattgcaagtagttgatatgcgtcgcgaattgctggatcagcttaacaaacagttgggtaaccagctgatgatggccattaacctgcaaatcaaccagcagcagttaatgagtgtgtcgaaaaacctgaaatccatcctgactcagcaaatcttttgggtgaacagtaaccgtccaatggactgggactggatcaaagcgttcccgcaaagcctgaaagatgaatttaagtcgatgaaaatcacggtgaactgggaaaaagcctggcctgccgtttttatcgctttcctcgccggtttgccgctgctgttgattgccgggctgatccactggcgtctgggctggctgaaagcgtatcaacaaaaactggcttccgctgtgggttccctgcgtaacgacagccagctcaacacaccaaaagcgatccttatcgacctgatccgtgcgctgccggtgtgcctgattattctcgcggttggcctgattctgttgaccatgcagctcaacatcagcgaactgctatggtcgttcagtaaaaaactggcgattttctggctggtgtttggcctgtgctggaaggtactggagaaaaacggcgttgccgtgcgtcactttggtatgccggaacagcagaccagccactggcgtcggcaaattgtccgcatcagtctcgcattgctgcctatccatttctggtctgtggtggcagaactttccccgctgcatctgatggatgatgtgctggggcaggctatgattttcttcaacctgctgctgattgccttcctggtatggccgatgtgccgcgaaagctggcgtgataaagagtcgcacaccatgcgactggtcaccattaccgtactgtcgattatcccgattgcgttgatggtgctgaccgccacgggttatttctacaccacgctgcgcctctccgggcgttggattgaaaccgtttatttggtgatcatctggaacctgctgtaccagacagtactgcgtggcttaagcgtggcggcgcggcgtatcgcctggcgtcgtgcgctggcgcgtcggcagaatctggtgaaagagggcgcagaaggtgctgaaccgccggaagaacccaccattgcactggagcaggttaaccagcagacgctgcgtattaccatgttgctgatgtttgcgctgtttggtgtcatgttctgggcaatttggtccgatttgatcaccgtgttcagctatctggacagcattacgctctggcattacaacggtactgaagctggtgctgcggtggtgaaaaacgtcaccatgggcagtctgttgtttgcgattatcgcctcaatggtggcctgggcgttgattcgcaacctgcctggtttgctggaagtgctggtgctctcgcgactgaatatgcgccagggcgcgtcgtatgccattactaccatccttaactacatcattattgccgttggtgcgatgacggtgttcgggtcgctgggcgtctcttgggataaactccagtggctggcagcagcattatccgtaggtcttggttttggtttacaagaaattttcggtaacttcgtctccggtttgatcattctgttcgaacgtccggtgcgcattggcgatacggtaaccattggtagcttctcggggacggtaagtaagatccgtattcgtgcgacaacgattaccgatttcgatcgcaaagaagtgatcatcccgaacaaagcgtttgttaccgagcgtctgatcaactggtcgttgactgacactactacgcgtctggtgatccgtctcggcgtggcctatggctccgatctggaaaaagtgcgtaaagtgttactgaaggcggcgactgagcacccaagggtgatgcacgaaccaatgccggaagtcttctttacggcgtttggtgccagcacgttggatcatgagctgcgtctgtatgtgcgtgaactgcgtgaccgtagccgtactgtcgatgagctgaaccgtactatcgatcagctgtgccgtgaaaatgacatcaatattgcctttaaccagcttgaagtgcatctgcacaacgagaagggcgatgaggtgacggaagtaaaacgcgactacaaaggcgacgatccgacaccagcggtagggtaaggacaataaagggcgacagtgatgccgccctttattttttactcgctttgcgaagcctcatcgctctgtaacttcttttcataatcacgcttcacaatatccagcgcgcgcagcacggtgcgggctgggatctgattttcttccagcagcacaatcaaatcgacagccagtttgacatcgtcaggggcattttccagtgacatactctctccattgctagcgggttaagcgcgctagcctgttttcgattttttccagcgcatggcggcagcgtgccaggcgcgcttcataggcttccacttcacgatgcagcgtttgctgttccacgagatcggtcacccgcgccaggcgggctcgacgttcagcaaccatctcacttagccgccgctcaaaatcctgatgctgaatacgtttacgctgccagcgggcaattttcggtggcgcactgtcccactcgcgtagcgaccaggctgtggcttcacgcgctatagcctccagttgcgccgccagatgttccgccagccaggcgacttgcggcagttgctgttgctcaacggcatgacgaagcgcagccaggttatcgcctgcctcatcgagacaagcctgcagtgttgtcgcacgagtctgaaaaaggtgcctgtcaaaacgggcgcttagcgtggcaaattgcgctaccggggcacaacgctggcgcagcgtagcgagctgtccttccagtttttccagcagcagggcggttttcacgataagacctcaatgaaaatgataattgttatgctaaagtagccactctgtaagctgacaacactcaatatgcaacgaatcattttaatcatcattggctggctggcggtagtgctgggtacgctgggcgtggtattaccggtattaccgacgacgccgtttatcctgctggcggcctggtgctttgcccgttcttccccgcgctttcacgcctggttgctgtaccgctcatggtttggcagctatctacgtttctggcagaaacatcatgcgatgccgcgcggcgtcaaaccgcgggcgattttgcttattttgctcacgtttgccatttctctgtggttcgtccagatgccatgggtgcgcatcatgttgctggtaattctcgcctgtttgcttttttatatgtggcgaattccggtgattgatgaaaagcaagaaaagcactgaagcacaacaatcgcagttgcaattattgcgtacagccagtacattctggcgttttcgagcacaggcgcaggcggtcaaaggttaaacaactgttacttttgatacgtttaaaacgcgccgtgagtaccaccgtaacaagcaggcatacacttatgaccgcgactgcacagcagcttgagtatctcaaaaatagcatcaaaagcattcaggactacccaaaacccggcattcttttccgtgatgtcaccagcttactggaagacccgaaagcttacgctctcagcatcgacttgctggttgagcgttacaaaaatgcgggcattaccaaagttgtcggcaccgaagcgcgtggcttcttgtttggcgctccggtagctctgggtctgggcgttggctttgtaccggtccgtaaaccgggcaaactgccgcgtgagaccatcagtgaaacttacgacctggagtacggcaccgatcagctggaaatccacgttgatgccatcaaaccgggcgacaaagttctggtggtggacgatctgctggcaaccggcggcactatcgaagcgaccgttaaactgatccgtcgtctgggtggtgaagtggctgacgctgcgttcattatcaatctgttcgatctcggcggcgaacagcgtctcgaaaaacagggcattaccagctacagccttgttccgttcccgggccattaatcatcgccagtcttgtgctgcccacgctacggacagcacaagatgtgcattcagcctcgccgttctgacggggctgtgttagcattaccccttcgtgaatccaccttccagcgtttcagagcctgccaatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggtacccgtggcgtcggaaaaacctctatcgcccgactgctggcgaagggactaaactgcgaaaccggcattaccgcgacgccgtgcggcgtgtgcgataactgtcgtgaaatcgagcaggggcgctttgtcgatctgattgaaatcgacgccgcctcgcgcaccaaagttgaagatacccgcgacctgctggataacgtccagtacgctccggcgcgtggtcgtttcaaagtttatctgatcgacgaagtgcatatgctgtcgcgccacagctttaacgcactgttaaaaacccttgaagagccgccggagcacgttaagtttctgctggcgacgaccgatccgcagaaattgccggtgacgattttgtcgcgctgtctgcaattccatctcaaggcgctggatgtcgagcaaattcgccaccagcttgagcacatcctcaacgaagaacatatcgctcacgagccgcgggcgctgcaattgttggcacgcgccgctgaaggcagcctgcgagatgccttaagtctgaccgaccaggcgattgccagcggtgacggccaggtttcaactcaggcggtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggcctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccagaccgccgtatgggcgttgagatgacgctgcttcgcgcgctggcgttccatccgcgtatgccgctgcctgagccagaagtgccacgccagtcctttgcgcccgtcgcgccaacggcagtaatcatgccaacccaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgtccggtgccatcggcgctggaaaaagcgccagccaaaaaagaagcgtatcgctggaaggccaccactccagtgatgcagcaaaaagaagtggtcgccacgccgaaggcgctaaaaaaagcgctggaacatgaaaaaacgccggaactggcggcgaagctggcggcagaagccattgagcgcgacccgtgggcggcacaggtgagccaactttcgctaccaaaactggtcgaacaggtggcgttaaatgcctggaaagaggagagcgacaacgcagtatgtctgcatttgcgctcctctcagcggcatttgaacaaccgcggtgcacagcaaaaactggctgaagcgttgagcacgttaaaaggttcaacggttgaactgactatcgttgaagatgataatcccgcggtgcgtacgccgctggaatggcgtcaggcgatatacgaagaaaaacttgcgcaggcgcgcgagtccattattgcggataataatattcagaccctgcgtcgattcttcgatgcggagctggatgaagaaagtatccgccccatttgatcgtaagcacagcttacgttcgtcatccttaacgtgattgagagagaaacctatgtttggtaaaggcggcctgggtaacctgatgaagcaagcccagcagatgcaagaaaaaatgcagaaaatgcaggaagagatcgcgcagctggaagtgaccggcgaatctggcgcaggtctggtaaaagtgaccatcaacggtgcacacaactgccgtcgcgtagagatcgacccgagcctgctggaagacgacaaagagatgctggaagacctggtggctgcagcattcaacgacgcagcacgtcgtatcgaagaaacgcagaaagaaaaaatggcttctgtatcctccggaatgcagctgccgcctggctttaagatgccgttctgatgcaaaccagcccgctgttaacacagcttatggaagcactgcgctgtctaccgggcgttggcccgaagtcggcgcagcgtatggcgttcacgctgcttcagcgcgatcgtagcggcgggatgcgtctggcgcaggcgctcacccgggcgatgtcggaaatcggccactgcgccgattgccgcactttcaccgaacaggaagtctgtaacatctgttcgaatccgcgtcgtcaggaaaacggtcaaatctgcgtggtggagagtccggcggacatctacgccattgagcagacggggcagttttcaggccgttattttgtgttgatggggcacctgtcaccgctggacggcatcggtccggatgatatcgggcttgatcgtctggaacagcgtctggcagaggaaaaaatcactgaagtgatcctcgccaccaaccccacggttgaaggtgaagctaccgctaactacattgccgagctttgcgcgcaatatggcgtggaagccagccgaatcgctcatggcgtaccggttggcggcgaactggaaatggtcgatggcaccacgctgtcacactcccttgccgggcgtcataagattcgtttttaagcaaacgagagcaggatcacctgctctcgcttgaaattattcccccttgtccccatctctccctcatcctgtttttaaccttaaaatggcattattgaggtagacctacatgaaaggacaagaaactcgtggttttcagtcagaagtgaagcagcttctgcacctgatgatccattctctctattccaataaagaaatcttcctgcgtgagcttatctctaacgcctccgatgcggcggacaagctgcgtttccgcgcgctatctaaccctgacctgtacgaaggtgatggcgaactgcgcgttcgtgtctctttcgataaagacaagcgtacgctgaccatctccgataacggcgtggggatgacccgcgacgaagtgattgaccatctggggactatcgctaaatccggcaccaaatcattcctcgaatccctgggttctgaccaggcgaaagacagccagctgatcggtcagtttggtgttggtttctactctgcttttatcgtggctgacaaagtgaccgtgcgtactcgcgcggcaggcgaaaaaccagaaaacggtgttttctgggaatcggctggtgaaggtgaatacaccgttgccgacatcaccaaagaagatcgtggtactgaaatcaccctgcatctgcgtgaaggcgaagacgagttcctcgatgactggcgcgtgcgttccatcatcagcaaatactccgaccatatcgcgctgccggtagagatcgaaaaacgtgaagagaaagatggcgaaaccgttatctcctgggaaaaaatcaacaaagcgcaggcgctgtggactcgtaacaagtcggaaatcaccgatgaagagtacaaagagttctacaaacacatcgcccacgactttaacgatccgctgacctggagccacaaccgtgttgaaggtaagcaggagtacaccagcctgctgtacattccgtcccaggctccgtgggatatgtggaaccgcgatcataaacatggcctgaaactgtacgtccagcgtgtgttcatcatggacgacgcagaacagttcatgccgaactatctgcgcttcgtgcgtggtctgattgactccagcgatctgccgctgaacgtttcccgtgaaatcctccaggacagcacggtaacgcgtaacctgcgcaatgcgctgaccaagcgtgtgctgcaaatgctggaaaaactggcgaaagacgacgcggaaaaataccagaccttctggcaacagtttggcctggtactgaaagaaggtccggcggaagatttcgctaaccaggaagcgatcgccaaactgctgcgttttgcttctacccataccgattcttctgcgcagaccgtgtctctggaagactacgtttcccgcatgaaagaagggcaggagaaaatctactacatcaccgcagacagctatgcggcagcgaagagcagcccgcacctggaactgctgcgtaagaaaggcatcgaagttctgctgctttccgaccgcatcgatgagtggatgatgaactatctgactgagttcgacggtaaaccgttccagtcggtgtctaaagttgacgagtcgctggaaaaactggctgacgaagttgatgagagcgcgaaagaagcggagaaagcactgactccgttcatcgaccgtgtgaaagccctgctcggcgagcgcgtgaaagatgtccgtctgactcaccgtctgaccgatacgccagcgatcgtttcgaccgacgcggacgaaatgagcactcagatggcgaaactgttcgctgcggcgggccagaaagtgccagaagtgaaatacatcttcgaactgaacccggatcacgtactggtgaaacgtgcggcagatactgaagatgaagcgaagttcagcgagtgggtagaactgctgctggatcaggcgctgctggcagaacgcggcacgctggaagatccgaacctgtttattcgtcgtatgaaccagctgctggtttcctgatgtaatgccggatgaccttcgtgtcatccggcatttttcttttcatcatctgcactttccgcaaattatctcgccattaaccgtttcagcctcaggtgcctttcttgaggcaatcgcctgttggtggtatcgtttatcgctttttcaaaaaaatcgacacattttaaggggattttcgcaatgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggttaccgacgaactggtgatcgcgctggttaaagagcgcattgctcaggaagactgccgtaatggtttcctgttggacggcttcccgcgtaccattccgcaggcagacgcgatgaaagaagcgggcatcaatgttgattacgttctggaattcgacgtaccggacgaactgatcgttgatcgtatcgtcggtcgccgcgttcatgcgccgtctggtcgtgtttatcacgttaaattcaatccgcctaaagtagaaggcaaagacgacgttaccggtgaagaactgactacccgtaaagacgatcaggaagaaaccgtgcgtaaacgtctggttgaataccatcagatgactgcaccgctgatcggctactactccaaagaagcggaagcgggtaacaccaaatacgcgaaagttgacggcaccaagccagttgctgaagttcgcgctgatctggaaaaaatcctcggctaatcaagccgcagcagatctgctttcgggcaggtctgctcatcctcctcaggcaatacctctcacagcaattagttcttcttcttctcttttccgctacaattatcaacaagttgaatcgataagaggcggtaatgcgtcagactaaaaccggtatcctgctggcaaacctgggtacgcccgatgcccccacacctgaagcggtaaaacgctatctgaaacaatttttaagcgacagacgtgtggttgatacctcacggttgttatggtggccattgctacgcggcgtgattttgccactgcgctcgccgcgtgtggcgaagctgtatgcttctgtctggatggaaggtggctcgccgctgatggtttacagccgccagcaacagcaggcgctggcacaacgtttaccggagacgcccgtagcgctgggaatgagctacggctcgccatcactggaaagcgccgtagatgaactcctggcagagcatgtagatcatattgtggtgctgccgctttatccgcaatactcctgttcaacggtcggtgcggtatgggatgaactggcacgcattctggcgcgcaaacgtagcattccggggatatcgtttattcgtgattacgccgataaccacgattacattaatgcactggcgaacagcgtacgtgcttctttcgctaaacatggcgaaccggatctgctgctgctctcttatcatggcattccccagcgttatgcagatgaaggcgatgattatccgcaacgttgccgcacaacgactcgcgaactggcttccgcactggggatggcaccggaaaaagtgatgatgacctttcagtcgcgctttgggcgggaaccctggctgatgccttataccgacgaaacgctgaaaatgctcggagaaaaaggcgtaggtcatattcaggtgatgtgcccgggctttgctgcggattgtctggagacgctggaagagattgccgagcaaaaccgtgaggtcttcctcggtgcgggcgggaaaaaatatgaatatattccggcgcttaatgccacgccggaacatatcgagatgatggctaatcttgttgccgcgtatcgctaaagctgagcggtaaagaactgagcgccgtcgcgaagagcctcgtcggcggttttcatcatccgtgaataatgcaaaaaggcgtgcagcgtgcctgggtagagtttgaactcacagggctgctgatgcgccgctaacgtctggtaaagcagacggctgtcatccagcagcggatcgaactccgccccggcaataaaacagggcggaacttcgcgagtgagatcattattaaacaggcagtaatacggcgactcgcggtccgcgtcgttgcttaaatacgcctcttcatacatctgtaaatcctgttgcgttaagccatcccagacaccgcccaacagacgacgagtcacggaatcccgtaatccgtaaagcccataccacagcaaaacgcccgcaactttaccgcaatcgatctgtttatcacgcaaccacaacgcactggcgagcgccagcatggcacctgcggaatcaccggcaaagccaatgcgggacatattgatttgataatcctccgcctgctggtggaaataacaacaggcagccacaatttcctctatcgcttgcggaaaacgcgcttcaggtgaaagggtgtaatcaataccaatcaccgtacattggctgtagcttgccagcaggcgcatgatgcgatcgtgggtatcgagattgccgagaataaaaccgcctccatgcaaataaaatagcgtcgccgggctatctggctgcggacaaaagagacgtgtttccacctgcccatattttgttggaaccatgtaagctctggttgccatttctggagcgcccgcattccagaatcggcgctcaagcgtgtaatactgtcgttgctcagcaatcgttcccgttgcgggccagggcggtaaatccggctgaagagtattcacaacagtcttcatttcagcagaaataaggtccagaacaggtaattttttttccggcttcatacaaaaactcctttcaaattacgtcattgtaaggaaccactgccatgaaaatgcgatcccgcctgctgatattgaaactggctgcgtctcgcgcgctcccgtcagattgtgttaacattcgccgctcagttaaccacccgtaaaaacaaccatgaaatttcccggtaaacgtaaatccaaacattacttccctgtaaatgcacgcgatccgctgcttcagcaattccagccagaaaacgaaaccagcgccgcctgggtagtgggtatcgatcaaacgctggtcgatattgaagcgaaagtggatgacgaattcattgagcgttatggattaagcgccgggcattcactggtgattgaggatgacgtagccgaagcgctttatcaggaactaaaacagaaaaacctgattacccatcaatttgcgggtggcactattggtaacaccatgcacaactactcggtgctcgcggacgaccgttcggtgctgctgggcgtcatgtgcagcaatattgaaattggcagctatgcctatcgttacctgtgtaacacctccagccgtaccgatcttaactatctacaaggcgtggatggcccgattggtcgttgctttacgctgattggcgagtccggggaacgtacctttgctatcagccctggccacatgaaccagctgcgggctgaaagtattccggaagatgtgattgccggagcctcggcactggttctcacttcttatctggtgcgttgcaagccgggtgaacccatgccggaagcaaccatgaaagccattgagtacgcgaagaaatataacgtaccggtggtgctgacgctgggcaccaagtttgtcattgccgagaatccgcagtggtggcagcaattcctcaaagaccacgtttctatccttgcgatgaacgaagatgaagccgaagcgttgaccggagaaagcgatccgttgttagcatctgacaaggcgctggactgggttgatctggtgctgtgcaccgccgggccaatcggcttgtatatggcgggctttactgaagacgaagcgaaacgtaaaacccagcatccgctgctgccgggcgctatagcggaatttaaccagtatgagtttagccgtgccatgcgccacaaggattgccagaatccgctgcgtgtctattcgcacattgcgccgtatatgggcggtccggaaaaaatcatgaacactaatggagcgggggatggcgcactggcagcgttgctgcatgacattaccgccaacagctaccaccgtagcaacgtaccaaactccagcaaacataaattcacctggttaacttattcatcgttagcgcaggtgtgtaaatatgctaaccgtgtgagctatcaggtactgaaccagcattcacctcgtttaacgcgcggcttgccggagcgtgaagacagcctggaagagtcttactgggatcgttaagttatcgtcggttcgtaggccagataaggcgttcacgccgcatctggcattttgctctcaatgcctgatgcgacgctggcgcgtcttatcaggcctacatatccgcgcctattatccggcaaccaccgtttaccccgtcaccacctcacccgccggtggcgtttcaagcagttccagcatagtacgggcgatttcccgctcacccatcactacctgatttgcaccacgttcggtgatatacgccacttcatcgtcataatgggcgcgggcaataatctcaatatccggatttttcgcgcgggcagatgccacaatctcacccgcttcataaccgttgggaatcgtcaggatcagccattttgcacattccagatgcgctagttgcataatttcttcgttcgccgcattgcccaatactgcgcggaccccgcgctctcgcagttcatcaacacgggttcgtgacgtctcaatcaccaccagcggaatatcagaggcgagcaatttctcccccagcaggctgcctacacgaccgtaacctaccagtagcgcatggttgcaaatatccactgggatctgcttctcttcttcgatagcctcttccagcgtctgctcttccagcgtttcggtcttcgccagatatttctccagcagcgcaaacaggaccggattgagcataatcgacaaaatcgcccctgccagtaccaggttctgcccggcttgcggcaacagatccagcgccatgcccagtcccgccaggataaacgcgaactcaccaatttgcgccaggctggcggcgatagttaatgccgtacgttgggagtgaccaaacagtcgcaccaggaaaaacgcggctaacgacttaccaaacagaataatcgccagcgtcgccagcactgccagcggttgttgaatcagaattaacggatcaaacaacatcccgacggagacaaaaaacagcaccgcaaacgcgtcgcgcaatggcagcgtatcgtgggcggcacggtgactcagttcagactcgttcagtaccatcccggcaaagaacgcaccgagtgcaaaggagacatcaaacagctccaccgcaccaaaggcaatccctaacgccagcgccagcaccgacagggtaaacagctcacgggaaccggttgctgcgctgcgtgccataatccacggcaccagacggcgacctaccagcatcataatggcgataaatgcgatcaccttgccgatggtgatccccatatcgacagcaagagtggcaaagcccacatcgccttgttccatcattcctgccactgcgggcagcaacaccagcgtcagaaccattaccaggtcttccacaatcaaccaaccgatggcgatttgcccacgctgactgtctattaattgccgttcttcaagtgcgcgcagtaacaccacggtactggcggtggaaaggcataagccgaacacgataccggtcattaacgaccagcccagcacggcggagagcgccatacccagcagcgtcgccacggctatctgggcgatcgcaccgggaatggcgatggcctttaccgccatcaaatccttgagcgaaaagtgcagacccacgccaaacatcaacagaatgacgcccagttcagccagttccggcgcaagcttggtatcggcaacaaagcccggagtgaatggtcctgccagcacacccgctaacagataacccaccagaggagaaatacgtagtttattggccagcatgccgaggataaaggcgagcacaaggccgccaacaatggtggtgataagcggggtggcgtgatgcattccgtctccttttcctggtggttattgtccatttttggccgggaaaaccaaaattacaggtaatagtttatgacaatttcattgatgatgtttatgaataattgttgaattttgcagaaaaatggaattagctgcaaaaaaagcacggatcggaaaacagaaggcgatttaacagaggaaaggcttatggcgactgtaaaacgatgcagccaaagtttgcctttggctgcaatgaaatcagtctttatgccggttatcaggcaggaatatggtcaacatccccaatagtggcaggaaagcacagattttatagactaactcgatgctggtgtggtcggcgataagccccagaactgccgctcccagacctcccatgccgaaagcaaaaccgaaaaagagtccagaaaccataccgatacgtcccggaagcagctcctgagcgtagaccagaatggcagagaatgccgaagcgaggataaatccaataatcactgttaaaacccccgtccagtgcaggctggcgtagggtaaaatcagcgtaaacggcgcaacgccgaggatagagccccaaatcacatatttccgtccaattttatcccctacaggcccgccgatcaccgtaccagccgcaacggcaaacaggaaggcaaacagatgaagctgggcattctggatagataatccgaatttttgcatcagataaaaggtgtaatagctgctgatgctcgccatatagaaatatttcgagaaaatgaggattaacagaatgctgaccgccagtaccactttgttgcgcggcagtggattgataatcgtcgcttttggttttcctttattcattcggtgctgtgccgagtaccaacggctgatttgcgccaacaccacgatcgccagcagtgccgcaagcacaaaccaggctacgttgcctttgccataaggcgcgataattaccgctgccagcaagggccccagggaactgccaaagttgccgccgacctgaaagatagattgcgccaggccatgccgcccgccggaagccatacgggctacgcgagaagattccggatgaaagaccgatgaaccggtaccgaccagcgccgccgccagcagaactgcgccaaaactgcccgctagcgccagcagcaccagaccacttaaggtaaagcacatgccaattggcaacgaccacggcatcggatatttatcggtccagtaaccgaccaccggttgcagtagcgaagaggcgagctggaaggtgagggttatcatgccaatctgcataaatgtcagagaaaactctgactgaagcagcggataaatcgccagaatcagcgattggatcatgtcgttcagcagatgtgagaggctgatagcacctaaaataccaaacgatgttcgggccttggtcgttgacgcagccgcgcccgccacaggctgggtttgttcactcattgccataggaaagtcactttttcagggttgcgatgtaaagaatgatcttatttgtgattattacccgactaacatacctgtatgcgtcgcctgaaggaagtctcaacgctgaatacagaatttctaatctggatgcagatttatcttcaccggacgcagacttgtctatgatgtcgcgtcatactatttttcaacacgttgaaatcaggtcagggagagaagtatgaaattattgcagcggggcgtggcgttagcactgttaaccacatttacactggcgagtgaagctgctctggcgtatgagcaggataaaacctacaaaattacagttctgcataccaatgatcatcatgggcatttttggcgcaatgaatatggcgaatatggtctggcggcgcaaaaaacgctggtggatggtatccgcaaagaggttgcggctgaaggcggtagcgtgctgctactttccggtggcgacattaacactggcgtgcccgagtctgacttacaggatgccgaacctgattttcgcggcatgaatctggtgggttacgatgcgatggcaatcggtaatcatgaatttgataacccgctcaccgtattacgccagcaggaaaagtgggcaaagttcccgttactttctgccaatatctaccagaaaagtaccggcgagcgcctgtttaaaccatgggcgctgtttaagcgtcaggatctgaaaattgccgttattggcctgacgacggatgacacagcgaagttaggcaacccagaaaacttcaccgatattgagttccgtaagcccgccgatgaagcgaagctggtgattcaggagctgcaacagacagaaaagccagacattattatcgcggcgacccatatggggcattacgacaatggtgagcacggctctaacgcaccgggcgatgtggagatggcgcgcgcgctgcctgccggatcgctggcgatgatcgtcggtggtcactcgcaagatccggtctgcatggcggcagaaaacaaaaaacaggtcgattacgtgccgggtacgccatgcaaaccggatcaacaaaacggcatctggattgtgcaggcgcatgagtggggcaaatacgtgggacgggctgattttgagtttcgtaatggcgaaatgaaaatggttaactaccagctgattccggtgaacctgaagaagaaagtgacctgggaagacgggaaaagcgagcgcgtgctgtacacccctgaaatcgctgaaaaccagcaaatgatctcgctgttatcgccgttccagaacaaaggcaaagcgcagctggacgtgaaaataggcgaaaccaatggtcgtctggaaggcgatcgtgacaaagtgcgttttgtacagaccaatatggggcggttaattctggcagcccaaatggatcgcactggtgctgactttgcggtgatgagcggaggcggaattcgtgattctatcgaagcaggcgatatcagctataaaaacgtgctgaaagtgcagccattcggcaatgtggtggtgtatgccgacatgaccgggaaagaggtgattgattacctgaccgccgtcgcacaaatgaagccagattcaggtgcctacccgcaatttgccaacgttagctttgtggcgaaagacggcaaactcaacgacctgaaaatcaacggcgaaccggtcgatccggcgaaaacttaccgcatggcgacattaaacttcaatgccaccggcggtgatggctatccgcgccttgataacaaaccgggctatgtgaataccggctttattgatgccgaagtgctgaaagcgtatatccagaaaagctcgccgctggatgtgagtgtttatgaaccgaagggtgaggtgagctggcagtaatccgaaagtgccggatgttcgcatccggcacaatgcttaatcgcggcgggcgatatcagcaaatttggcatcgaggatcttcgccagatcgcctgccgccagttcgatatccagcccgcgcttgccgccggaaacataaatagtggcaaattcttgtgcgggggcgtcgataatcgttggcagacgttttttctgccccagtgggctaatccccccaaccagatatcccgtcgaacgctgcgcaaccatcggatcggccatctcaactttcttggcacccagcgcttttgctacttttttaagatccagttgacctgcgaccggcgtaacggccacggcaaggtgtttcatatcaccgttcactgcgaccagcagcgttttgtagacctgatccggattcaaacctaattttttgacgacttcatcgccaaaattggtttcagccggatcgtgctcgtaggtatggatttgaaacgaaatcttgtttttttcgagtaatttaactgcgggtgtcatggtaattttcctgccttaaacaaaaaaacgaagcaagcatacgcctgatggcggtccaaaaaaaagagtcatcttgcctaagagtattggcaggatggtgagattgagcgacaatcgagttacaccgtcgcttaaagtgacggcataataataaaaatatgaaattcctctttgacgggccaatagcgatattggccatttttttaacgcaacatctgcggcaaattcccttctccatacaggtgtagtgcaccgactgcgaccacatagcgccccggcggcatggcgcataatttgtcccgccaggcgagatttcgctgatgcatcagcacatcgtacagcgactgactgaacgtattaggcagcgttatttcattattttgcggcggcgcattcagccaccagctcatcatttgttgcagcaaccgtgcattggtgtgccagtgggtcagcgtatcgtccagcagtgccagtccgttgtcagggagctggagcaacatggcaatctggttttcagccccttccagttcaatcacgggtttatgttgttgcttcgccgcctgcaatagctggtaatcgataccgtattctgcccgcagccccagtttttgtgcctgtgtcgcctgaagaaccatcgcgatttgccacagcggttgggtagaaaagagtgagggagaaatgcccatctcctggctaatgtgctgcagattttggagttgctcctcgctaatgcgctcttccagcgcctcgcaggcaggcaaattagcaaaaggcgtatcgctggtggaaacatccgcctcgacgatcagcgcatcggcgtttttgagctttttgagcaaacgggtgggcaggggagccatatcgtggctgcccatatgaatactgccaatcagatgaaaatggcgattgccgggaagagagatatcgatagcaggccaggtgtaatgattaccgcgcagcgcggcccaaagcgtttttacccggtacaacagatccatacgacctccctttgtgaaatatcatgctagcgcgcggggagggatggcgcaaatcgcaaatggagttggggacttgtttgatgtgtttgtatgcgtgcaaaaaaggtcgcgtagaataatttccctataacggatgcgccaccctaaagcagcgcatccgcaatgatgtacttattccttcggtttaaaccgcagcaaccggttggcgttactcactacggtaatcgatgagagcgccattgccgctccggcgaccaccgggttaagcagcgtaccggtgaacggccacaaaataccggcggcgaccggaataccgatactgttgtagataaacgcgccgagcaggttctgcttcatattgcgcagcgttgcgcgggaaatagcgagcgcatccgcaacgcccatcaggctatggcgcatcagggtaatcgccgcggtttcaatggcaacatcactgccgccccccatcgcaatgccgacatccgcctgggccagcgctggcgcgtcgttaatgccgtcgcccaccattgccacctgacgtccttcactttgcagatgtttgatcgcttcggctttaccgtctggcagcaccccggcgatcacctcatcaatccctgcttctttggcgatcgcattggcggtggttgggttatccccggtcaacatcaccagacgatatcccgctttatgcaggcgttgcagcgccgccacgctatcactacgcaatggatcgcgtacagccagcagggctaccgctttcccgtcaaccgccagcagcacaggcgttgccccttgcgatgcctgagctgaaatatctgcctcaatcgctttagtatcaacttgctggtcatttaacagcgcctgattgcccagcaataccgcatgaccttcagcttcaccgctcacgcccagcccgcgcaatgtgcggaaaccgttgacctgcggcagctgcatatcacctgctttatcgaggatcgctcgtgccagcggatggctggaaccttgctccagcgccgccgccagacgcagcgcctgcgcttcgtcaacatcagcaaatgttttcactgcgacaacctgcggcttcccttcggtcagcgtcccggttttatcgaacactacggtatcgagcgtactggcgcgttgcagcgcgtcggcgtcccgcaccagcacaccaaactcagccgcccgcccgacgcccgaaataatcgacatcggcgtcgccagtcccagcgcacacggacaggcgataatcagcaccgtggtggcaatcaccagggtataaacaatttgcggtgccgggccaaagaaataccagattgccgcactgaccagcgcaatgactaccaccaccggcacaaacacagcggagattttatccgccagttggccgatttcaggcttgctgctctgggcctggcgcaccatacgaataatccgcgacagcgtggtatggctgccaaccgcactggcacgaaacagcacactgccgtcctgtaccactgtcccggcatggacgctatcgccttcgcctttttgctgcgggataggttcgcccgtcagcatcgcttcatccagccacgcttcgccctgggtaatctcaccatctaccggcacacggtcgccggtcgtcaggcgcagtaacatacctggctgaacatctgccagcggcacgtttttttcaccttcgtcggtgaccaggcgcgccgtcggtggggttaaatcgagtaatttctccagcgccttagaagaacgctgacgcgcgcgcgcttccagcatatggccgagattgatcagaccgataatcatcgcgctggcttcgtaataaagatgtcgcgcttccatcgggaaccactgcggccacaggttgacgctcatcgaatagagccacgctacgccagtacccagcgctaccagcgtatccatcgttgccgcaccgtttagcaggcttttccatgcgctgcggtaaaaatggccgccggcaaaaaccattaccgccagggttatcaggccgataaccaaccacaggctgcggttgtcagcggtgaccatcatgttatcgccgatcatcccccagaccatcaccgggatacccaccgccagtgcgacaatcgcctgccagcggaagcgcttcatcgtagcgacggcggtttcttgctggcgctcgcggcgtttagcgtcatcttcaatcgcttccgcgccgtagcccgctttttccaccgcctgcactaaatcttgtggggaggcactgcccatcaccagcgcagtacgctccgccaggtttacccgtgcctgagtgacgcccggtacgctttgcagcgcattttgtacgcgggtgacacagctggcgcagctcatgccgctcagcagcaactgctggctgtcatcgtcatcggcggtcgctgccggaagcgcctcagaaaccgctgtcagtgcttccgacgggattgatgactccgccagcggtttagcctttgggtggcttacagatgcgtcataacccgcttgtttgatggtttcgatcagctgttctgcactggcagtcccggtaacgtgcgcttcagtgacagacacatccgcctgctcaacatccgggcgctgttcgagactttctttcacgcgtttaacgcagtgaccgcaggacaggccgtccagggtcaggtcgatagtttgtgacataaaacactccttttaagacagttttgactggctgtgataaaggttaaaccttccagcaaggggaaggtcaagaaattaataaaccaggcgggtaaaagtccgtaaagattaaaaaatcggctcgatttgcatcaggattagacatttatctctttgttttcctgtagttaagttgcgggtgctaagttaaatcaggatgcctgaaaatcggcaccggggtgaggaattacctcccgcatctataaaaaggagttaacaaaagatgttagatgcaaacaaattacagcaggcagtggatcaggcttacacccaatttcactcacttaacggcggacaaaatgccgactacattccctttctggcgaatgtacctggtcaactggcagcagtggctattgtgacctgcgatggcaacatctatcgcgcgggtgatagtgattaccgctttgcgctggaatccatctcgaaagtctgtacgttagcccttgcgttagaagatgtcggcccgcaggcggtacaggacaaagttggcgctgacccgaccggattgccctttaactcagttatcgccttagagttgcatggcggcaaaccgctgtcgccactggtaaatgctggcgctattgccaccaccagcctgattaacgctgaaaatgccgaacaacgctggcagcgaattttacatatccaacaacaactggctggtgagcaggtagcgctctctgacgaagtaaaccagtcggaacaaacaaccaacttccataaccgggccattgcctggctgctgtactccgccggatatctctattgtgatgcaatggaagcctgtgacgtgtacacccgtcagtgctccacgctcatcaatactgttgaactggcaacgcttggcgcgacgctggcggcgggtggtgtgaatccgctgacgcataaacgcgttcttcaggccgacaacgtgccgtacattctggctgaaatgatgatggaagggctgtatggtcgctccggtgactgggcgtatcgcgttggtttaccgggcaaaagcggtgtaggtggcggtattctggcggtcgtccctggcgtgatgggaattgccgcgttctcaccaccgctggacgaagaaggcaacagtgttcgcggtcaaaaaatggtggcatcggtcgctaagcaactcggctataacgtgtttaagggctgatcatgatgaacacggaaggtaataacggtaacaaacccctcggtctatggaatgtcgtttccatcggcattggggcaatggtgggggcggggatcttcgcgctgctggggcaggctgcgttgctaatggaagcctcgacctgggtcgcctttgcttttggcggtattgtggcgatgttttccggttatgcctatgcgcgtctgggggcgagctatcccagcaatggcggcattatcgacttctttcgtcgcggattaggcaacggtgtcttttcgctggcgctctcgttactgtacctgttgacgctggcggtgagcatcgccatggtcgcccgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgatcattgcaggtgtctggtcgctgcaaccggcgcatatttccgtctctgcgccccccagctccggtgcgttcttctcctgtatcgggataaccttccttgcctatgcgggctttggcatgatggcgaacgcggcggataaagtgaaagatccgcaggtcattatgccacgggcgtttctggtggcgattggcgttaccacgttgctttatatctcgctggcgctggttttgcttagcgatgtatcggcattagagttagaaaaatatgccgatactgccgtagcgcaggcagcttctccgctgctcgggcatgtgggttatgtgatcgtcgtcatcggcgctttactggcgacggcttcagccatcaacgcgaacctgttcgccgtgtttaacatcatggacaacatgggcagcgaacgcgaactgccgaagctaatgaataaatccctgtggcggcagagtacctggggcaacatcattgtcgtggtgttgattatgctgatgacggcggcgctgaatttaggctcactcgccagcgttgccagcgccacctttttgatctgctatctggcggtgtttgtggtggcgatccgcctgcgtcatgatattcacgcctcgttgccgattcttattgttggtacgttggttatgttgctggtgatcgttggctttatctacagcctgtggtcccagggcagccgtgcgttgatatggattattggcgcaatcttactcagccttattgtggcaatggtcatgaagcgcaataaaaccgtataacacctctctgtgcgcagtacttcctgtactgcgcctttgtctttaattcaaatttcctttcttattcctttaataaataagtcacaaaaaaatgatatatacgcgataaatctgtgatgctaatcacttattaccgtggattattcttaatgtgtatgatggtaatctaaaagtcgtagtgtattctaaataaataacgtataagctttttagctgcatttctttgccaatatcaatggtcgacaaaagagatgcacaagttattacccttcttaataaaatgagactggttataaaaaccagttaaaataatgacctggaaggaagtgacttatctatggcgcgattccagtttaaaagccgtaaaaataatgggtttatttttttaataagttttatggtgatgggagaagctacaattgctgcaccgctgccacaatgggcgaacgccccagcggtaacgccagttgcccgattatctttacaggaaagtatattacgcgcctttgcgcgaaatcccgacgtcactcaacaggcggcgcagataggcattggcgaagcgcaaattgatgaagccaaaagtgcctggtatccgcacgttggattaaccggcaacgcggggccgtcccgacaaacggactccagcggcaggcttgataacaacgtttcgtatggcataaccctgacacagctggtgtatgactttggtaaaacaaacaacgatatcaatctgcaaactgccgcccgtgacagctaccgctttaaattgatggcaaccttaaccgatgttgcagagaaaacggcgactgcctatatggaagtcagtcgttatcaggctttgtgcgatgcggctcaacgcaatattcactcgctggaaaacgtctacaacatggcggcattgcgcgctaacgctggcctgaactcatcgtcggatgaattacaagcccagacgcgtattgccggaatgcgctcaacgctggagcaatatcaggcgcagatggcgagcgccaaagcgcaactggcggtgctcactggcgtacagccggaggcgatagccgcgccacctgctgaattagccgagcagccggtgtcgctgaaaaatattgattaccagtccatcccgctggtgctggcggcagaaaacttacgccagtcagcacagtacggcgtggaaaaaacgaaagcgcaatactggccaacgctgagtattcaggggggcaaaacgcgctaccagaccagcgaccgctcgtattgggatgatcagctacaactgaacgttaacgcgccgctgtatcagggcggcgcggtttctgcccaggtgcaacaggccgaagggcaacaaaaaatctctgcctcgcaggtcgaacaggcaaaactggatgtgctgcaacgagcgtctgtggcatatgccaactggacaggcgcacggggtcgcgaagaagccggtttagcacaatccgaaagtgcgcacaaaacgcgagatgtgtaccaaaatgaatataaattgggcaaacgcagtctgaatgatctattaaccgtcgagcaagatgtctttcaggcgcaatcggctgaaataaatgccaattatgatggctgggtcgccgccgtaaattatgccgctgcggtgaataaccttattccattagcgggaattaaacagggcttatacaacgacttacccgacttgaaataatcctgccattattaatatcaggtatgcctcgttgttaagtgattacctttgtcttatttagataaatggactcgctaaggatgtgcgccatttatcaggaatgccattatgagcctgattattgatgttatttcgcgtaaaacatccgtcaaacaaacgctgattaatcctggcgacgtcacggttgttatttatgagccttccgtggtgcaggttcatgctcaggcctctgccgttgcgcgttacgtccgtgaaggaaatgacctgctgatctatatgcaggacggcacggtgatccgctgcaacggttatttcctgcaagcggcgaataccgctgaacaatcggaactggtgtttgccgatggacaacagctcacccacgtcacctttgccgatactgctgcgggtggattagcccccgtagaactgactgcccagaccaccgcgattgaaagcattgcgccatttcttgataccgttgctcagaccagcaccttcccgtggggatggctggcgggggcggcggtaggcggtggcgcgcttggtgcactgctggcaagcggtggcgatggcgactcgaaaacggaagtgattaataaccctacgccacccgctgagcctggcaacgccactccatcatttttagttaccgataatcagggcgatcagcgcggcattctcgccaccaatgacatcaccgatgataccacgccaacctttagcggcagcgggcaggcgggggcgactattcagattaaagacagtaacggcaatactattgccagtactcaggtagacaacaacggtcactggagtgtctcgttacccacgcaaagtgcaggtgaacatacctggtcagtggtgcaaattgtcggcagtaccatcactgacgccggttcgataacgttaaccatcgacaatagtcaggccagcgtgcaggttgccaccaccgcaggcgataacattattaacgccagcgaacaggccgccgggtttacgctttctggtaccagtagccatctggcgcagggaacagaactcaccgttacgctaaacggcaaaacctacaccaccagcgtaggcgctaacggtgcctggagcgtgcaggtgccgaccgccgatgcacaggcgttaggcgaagggaatcaggcagtgctggtcagcgggaaagacgccacaggcaatacggtcaccggcgcgcagcttttaacggtcgatacccaaccgccaacgcttgccatcaacactatcgctcaggacaacatcgtcagtgctgcggaacataacgccgcgctggtactgagcggcacgtcgaatgcagaagcggggcaaaccgtaaccctgaccgtcaacgggaaaagccatacagcaaccgtcggtagcgacggaacctggcaagtgacgctgcctgccacggaggtccaggcactggcggaggggaactacgctgtcaatgccagtgtcagcgatcgggcaggaaacaccaccagcaacagcgcgaatttcacggtagacacctcagcacccgtggtcagcgttaacaccgtggcgggcgacgatattcttaataatgccgagcaggccgtcgcgcagatcatctccggacaagtcagcggtgcttctccaggcgatacggtaacggtgaaattgggcactcatgtcctgacgggcatcgtgctggcggatggcagctggaatgtggcgctggacccggcggtaacccgcacgctggatcgcggagccaatacgattttcgtcaccgtaacagatgctgcaggaaatactggcgcggcgtctcgagcaatcacgctggtcggtgtttctccgttgatcaccattaacaccgtctctggcgatgacattatcagtggcgcagaaaaaggtgcgccactgacccttaccggtagcactcaacaggccgagacaggacaaaccgtcacagtaaccctggctggacagagttttaccactaccgtgcaggccgatggctcctggagtctgacggtacctgccgccgcgatgggaaatctgcctgacggcgcggtggcgattaccgcttctgtgacggatctcagcggcaataccggcaacacctcccgcaccattaccgtcgacagccaggccccggcgttgagcatcgactcgctgactgccgataacatcatcaacgccgccgaaagtgggcaggatctgcccatcaccggcaccaccgacgctcagccagggcagacggtgaccgtcacgctgaacgggcagacctatcagggcgtcgtgcagtccgacggcacctggagcgtgaccgttcccgccgccaatgttgacgcactggctgacggcaacgccacggtcaccgccagcgtgaacgatgtcgccggtaacccgaccagcgtttcacgcgtggcgctggtggatgccacgcctccggtggtgaccattaatccggtggcgaccgataacgtcatcaacacgccggaacacacccaggcgcaaatcatcagtggcacggttactggcgcgcaggcgggcgatattgtcaccgttacgttaaataattccgattacaccacggtggtggatggttccggcaactggagtctgggtgttccggcttccgttgtcagcggactggtggatggcagttatcctgtcagcgtctcggtaaccgacaaagccggaaacacgggcagccagtcgctaaccgtcacggtcgataccgccgctccgatgattggtattaacactattgcgggcgatgatgtgattaacgccagcgaaaaaggggccgatgttcaaattaccggcaccagcgatcagcctgttaataccgccatcaccgtaacgctgaacgggcaaaattacaccaccacgaccgacgcctccggcaactggagcgtgacggttccggcattggcggtaaccgcactgggtcaggccaactacacggtaacagcggcggtgaccaatagtatcggcaacagcaacaccgccagccataacgtgctggtcgacagcgcgctgcccggcgtgaccattaacctggtggcaaccgacgatattattaacgccgccgaagcgggcgttgcgcaaaccattagcgggcaggttactggcgcggaagatggcgacacgataactattacgttgggcggtaatacttatacggcgacggtgggcagcaatctcacctggagcgtgagcgttcctgcggcagatattcaggcgctgggcaatggcgatttaacggtgagcgcctcggtcaccaatcaaaacggcaacaccggcagcggcacgcgggatatcaccatcgacgccaatctacccggtctgcgggtcgatacggtggcgggcgatgatgtggtcaatattattgagcatgggcaggcgctggtgattaccggcagcagctcggggctggctgaaggcacgccgcttaccgttacgattaacaatgtggaatacatcactgcggtgcaggccgatggtagctggagcgtgggcgtcacggcggcgcaggttagcgcctggcctgcggggacggttaatattgccgtatccggggaaagtagcgccgaaaatccggtgagcattacgcatccggttatggtcgatctcacgccggcggcgattaccatcaacaccatcgccacggacgacgtgattaacgccgcagaaaaaggcgctgatttaacgctttccggcaccaccactaacgtagaacccggtcaaaccgtcaccgtcacctttggcgggaaaaattacactgccagcgtagcgagcgatggtagctggactgccaccgtacccgccgccgatctggcgtcattacccgagggcagcgcctccgcacaggccagcgtcagcaatatcaacggcaatagcgcctcggcggtgcataactacagcatcgatagcagtgccccgaccatcattatcaataccgtcgccagcgacaatatcgtcaacgccagcgaagccgatgcgggtgtgacggtgagcggcagcaccaccgctgaagcggggcagattgttacggttacgctcaatagcccgaccgtgcagacctatcaggcaacggtgcaggcggacggcagctggagcatcaatattccggcggcagatcttgaggcattgaccgatggcagccacaccctgaccgccacggtcaatgacaaagcgggcaacccggcgagcaccacgcataatctggcggtggatctcaccgttccggtacttaccatcaacaccattgcgggcgacgatattattaacgccgccgaacacgggcaggcgctggtgatttccggttccagcactggcggagaagcgggggatgtcgtcaccgtcacgctaaacagtaaaacctacaccacgacgctggatgcttccggcaactggagcgtcggcgttccggcggcggatgtcacggcactgggcagcggcccgcaaactgttaccgccacggtgactgatgcggcgggtaatagcgataacgagacgcacacggttaccgttaaccttgctgcgccgaccattggcattaacaccattgctaccgatgacgtgattaacgccaccgaaaaaggcgcggatctgcaaatttccggcaccagtaatcagccagcaggcaccacaattacgctgacgctgaacgggcaaaattacactgcgacgacggacgccgcaggcaactggagcaccacggtgccagcttccgcagtcggtgcgctgggcgaagccagctacacggtgacggcgaacgtcaccgacagcgcgggcaacagcaattccgccagtcataacgtgcaggtcaataccgcgctgcctggcgtcacccttaatccggtggcgagcgacgacattattaacgctgccgaatcgggcgtggcgcagaccatcagcgggcaggtgacgggcgcggcggcgggcgatacggttaccgtaacgcttggcgggaaaacttacaccgctaccgtgcaggggaatttaagctggagcgtggacgttccggcggcggatattcaggccatcggcaatggcgacctgacagttaatgcctcggtgaccaacggcgttggtaataccggcagcggttcgcgagatattactatcgacgctaatttgcctggcctgcgcgtcgataccgtggcgggcgatgatgtggtcaacagcatcgagcacagtcaggcactggtgataactggtagcagcagcgggctggcggcgggcgcggcgctgacggtggtgattaacacggtcacttacgctgcgacagtattagccgatggcacatggagccttggcgttccggcggcagatgtgggcaactggcctgcgggtacggtgaatatcacggtttcaggtgccactagcgcaggaaacccggtcactatcacccatccggtcaccgtcgatctggcggcggtggcgatctccattaacaccgtttccggcgacgatgtgattaacgccgccgaaaaaggggcagatttaaccctttccggcagcacctccggcgtggagctggggcaaacggtcaccgttacctttggcggcaaaacctacaccgccaccgtagcgggcgatggcagctggacaaccagtgtacctgctgccgatctcgccgcattacgcgacggcgacgccacggtacaggccagcgtcagcaatattaacggcaacacggcttcggcgacccacgcctacagcgtcgatgccacggcaccgacgtttgccattaacaccatcgccaccgacgatattctgaacgccgccgaggcgggcaatccgctaaccatcagcggcagtagcaccgccgaagcggggcagacggtaaccgtcacgcttaatggcgtgacttacaccggcaccgtccaggcggatggcagctggagcgtcagcgtgccgacggcggatctcagcaatctgaccgccagccagtacacggtcagcgcctcggtaagcgataaagcgggtaacccggcaaccgccactcatgggctggcggtggatctcaccgttcccgtattaaccatcaacaccgtctccggcgatgacattattaacgctgccgaacacggacaggcgctggtgatctccggctccagcactggcggggaagcgggcgatgtcatcaccgtcacgttaaacagtaaaacctacaccaccacgctggacgcttccggcaactggagcgtcggcgttccgctgtcagacgttactgcccttggcagcggcccgcaaaccatcacagctaccattaccgacgcggcaggcaacagcgatgatgccagccgcacggtcaccgtgaatctgaccgcgccaaccattggcattaatactattgccgacgatgacgtgattaacgctacggaaaaaggcgcggatctgcaaattaccggcaccagtaatcagcccgcaggcaccacaataacggtgacgctgaacgggcaaaattacaccgccataacagatgcttccggcaactggagcgccacggtgccagcgtcagcggtcagtgcattgggtgaggccaactacacggtaaccgcgaacgtcaccgacagcgcaggcaacagcaattccgccagccataacgtgctggtcaacagcgcgttacctgccgtcaccattaacgcggtggcggccgatgacattattaacgctgccgaagcgggcaatgcgcaaaccatcagtgggcaggtgacgggtgccgcggcgggcgacacagttaccgttacgctgggtggcaacacctacaccgccacggtgcaggctaatttaagctggagcgttagcgtgccggcggcggatattcaggccatcggcaatggtaatctcacagtaaacgcctcggtcactaatggcgtgggcaacaccggcagcggctcgcgcgatatcacgatcgatgccaatctgcctggcttgcgggtcgataccgtggcgggcgatgatgttattaacagcattgagcacaatcaggcgctggtgataacaggtagcagcaccgggttaacggcgggaacggcgttaacggtcgagattaacaacgttacttatggcgcgacggtattagccgacggcacgtggagcctcggtattccggcggcagacgtcagcaactggcctgcgggtacggtggatattacggtaagcggcaccaacagcgccggaacaacctctaccattacccatccggttaccgtcgatctggcggcggtcgccatcaccattaacaccctttccggcgatgatgtgatcaacgccgtggagaaaggcgaaacgctggtcgtaagcggcagcaccagcggtgtggaagctgggcagacggtgaccgtcacctttggcggtaaaaattacaccaccactgtggaagccaacggcagctggacggtgaatgtgccgcctgccgatctcgctgcgctaccggacggcgcgggcaacgtgcaggcgagcgtcagcaatattaacggcaacagcgcccaggccgatcgcgcgtatagcgtcgatgccaccgcgccgcttattactatcaacaccatcgccagcgacgatactcttaacgtgagcgaagcgggcgcggggatcaccatcagcggcaccaccacggcgcaggccgggcagacgctgaccgtcacgctcaataacaacacgtaccagaccaccattctcgcggatggcacctggagcgtgaacgttccggcaacggatttaagcggattaaccgccagcagttataccgtgactgcgacggtgagcgacaaagcgagcaacccggcaagcgccgatcatgcgctggcggtggacgttaccgctccggatctcaccattaacaccgtcgcgggcgatgacatcatcaacgctatcgaacacgggcaggcgctggtggtgagcggcaccagcacgggcgcggcggcaggcgatgtggtgaccgtctcgctcaacggcaaaaactacaccaccacgctggatgcctctggtaactggagcgtcggtatcccggcggcagatgtgacggcgctggcaaccggaagccagaccattactgccagcctgagcgatcgcgcgggcaacagcgacagcgctacccataatgtcaccgttgatcttagcggcccgacgctgaccatcagtaccgtctccggcgacgacatcatcaataatgcggagaaaactcaggatctgaccatcagcggcggctccagcggtctggcgaccggcaccacggtcaccgtgatgttgaacggcctggcgtacagcgccaccaccgatagttccggcaactggagcgttaccgtgcctgcttcggcggtcggtgccctgggcgaggcggtctattcgattagcgccagcgccaccgacagcgcgggcaacagcggcagtaccacccatacggtgaatgtcgaatcgctcctgcctggggtgatcattaataccgtggcgggcgatgacattatcaacgccgctgaaatcgttgtggcgcagaccatcagcggtcaggtcacgggaacggcggttgccgggaatacggtgattgtcaccattggcggcaatcaatataacgccaccgtgcagtcagatttaagctggagcgtcagcgtaccggcgaacgttttgcaggcgctgggtaacggtgaactgaccatcagcgcctcggtgaccaattccgcaaataataccagcaccgcgacgcacgatatcgtgatagatgccaacctgccaggtctgcgcgtcgataccgtggcaggcgatgatgtgattaacagcatcgagcacactcaggcgttggtgatcaccggtagcagtagcggactggcggcgggcgcggcgttgacggtggttatcaatagcgtcacctacggcgcaacggtactcgccgatggcagctggagcgtcggtgttccggcggcagatgtcacaaactggcctgcgggaacggtcaatattgccgtttctggcaccaataccgccggaaccacaaccagcattagccatccggtcacggtcgatctcgcggccgtggcgattaccattaacaccctttccactgacgatgtgattaatgccgccgaaaaaggcagcgatttgcagctctccggcaccacctccgatgtggaagcggggcaaaccatcaccgttatcttcggcggcaaaagctacaccaccacggttgccgcgggcggcacctgggggctgacaatcccagcagccgatctcgcaaccttgcctgacggcgcagcaaacgtccaggccagcgtcagcaacgtcgcaggtaacagcgcccaggcaacgcatgcttacagcgtcgatgccaccgcgccttccgttaccatcaacaccatcgccacggacgatattcttaacgccgacgaagcgggatcggcgctgaccatcagcggcaccagcacggcggaagccgggcagacggtgaccgtgacgctaaacggcgtcaattacagcggcaacgtgcaggcagacgggagctggagcgtcagcgtcccgaccggcgatttagctaacctcactgccagcccctatacggtgagcgcagcggtcagcgacaaagccggaaatccggcctcggcgacgcataacctgacggtggatcttgttgcgccggtcgttaccattaacacggtagcgggcgatgacatcattaacgccacagaacacggacaggcgcagattatcagcggctcggcaacgggcgcgacgaccggtaacacggtgtccgtgacgattggcacgaccacttacaccaccgtgctggacgccaacggcaactggagcatcggcgtgcctgccagcgtgatttccgcactggcgcaggggaatgtgaccattaccgccacggtcaccgactccgcaggcaacagcggcacggcctcgcacactgtcagcgtggcgctcggcgcgccgatactgagtattaacaccatcgccgttgatgacatcattaatgccacggagaaaggcgcggatctggcgatttccggaagcagcaaccagcctgcgggtacgcagataaccgttacgctcaacgggcaaaattacaccaccactgccgatgcatccggtaactggagcgtgaccgttccggcgtcacgggtgagcaccctcggtgaagccacttacacggtgactgccgccgccactgacgccgatggcaacagcggttccgccagccataacgtgcaggttaataccgcgctgccgggcgtcaccattaacgttgtcgcgagcgacgatattattaacgctgccgaagcgggcgcgggccagagcatcagcgggcaggtgacgggcgcggcagcgggcgacacggtaaccgtcacgctcggcgaggcgacttacactgccacggtgcaggcgaatttaagctggagcgtcgatgttccggcctccgcgctacaggcgttgggcaacggtgaactgaccatttcggcttcggtaacgaacagcgtaggcaataccggcaacggcacgcgcgaaatcaccatcgacgcgaatctccccggtctgcggattgacaccgtggcgggcgatgatgtggtcaacattatcgagcacgggcaggcgctggtgattaccggcagcagctccgatctggcagcgggcagcaacgtcacgctgaccattaacgggcaaacctatgttgcggcggtactggcggatggctcatggagcgtcggcgttccggcggtggatgtcagcgcctggcctgcggggacggtcacgattacagccagcggcaacaccaccgccggaaacccggtgagcgttacgcatccggtgactgtcgatctcactgcggtggcggtcagcatcaacgccattactgccgatgacgtgattaacgctgccgaaaaaggcgcggcgttaacgctctctggcagcacttctggtgtcgaagccgggcaaacggtcaccgtcacctttggcggcaaaacctacactgcaagcgtcgcggcgaatggttcctggagtaccacggttccggcgacagatatggcagccctgcgtgatggcgatgccagcgcgcaggccaacgtcagcaatgttaacggcaacagcgccaccactacccacgcttacagcgtcgatgctaccgcgccaacggtgaccattaacaccattgcgggcgacgacattcttaacgccgccgaagccggagcggcgctgaccatcactggcagcagcacggcggaagcggggcagacggtgaccgtcaccctcaatggtgcaaactatactggcaccgtacagacggacggcagctggagcatcagcgtaccgccagccgacttaagcgccctgaccgccagcaactacaccgttagcgcggcggtgagcgacaaagtcggaaacccggcctcggttaatcacaacctgacggtggatacgtctgttccggtcgtcaccatcaacacggtggcaggcgatgatgtgatcaacgcgacggaacacgcccaggcgcagattatcagcggctccgccacgggtgcggcaaccggcagcgccgtgacggtgactatcggcacaaacacctttaccaccgtactggatgccagcggtaactggagcgtcggcgttccggcaagcgtcgtctcggcgctggcgaacggcacggtgaccattaacgccagcgtcaccgatgccgccggaaacagcggcagcgctacgcatctggtgacggtcaatactggccttccgtcaattacctttaacgccatcagcggcgataacgtcctgaacgccgatgaaaaaggccagccgttgaccattagcggtagcagtacggggttggcgaccggcgcacaggttaccgtcacactcaacggtcataactacagcgctaccaccgacgcggcgggcaactggacgttaaccgtgccggtgagcgatctggcggctttaggccaggccaactatatcgtcagcgccagcgccaccagtgcggcaggcaacatcgccagcagccaggcgaatttactggtcgatagcggcctgccgggcgtcaccatcaacaccgtggcgggcgatgatattatcaacgccgccgaagccggggccgatcaaaccatcagcggggtggtcactcgtgccgccgctggcgatacggttaccgtcacgctgggcggcaacacttacaccaccacggtacagggcaacttaagctggagtatcagcgttccggcagccgatctccaggcgttgggcaatggcgatttgaccattaacgcttcggtcaccaacgcgaatggcaatacgggcagcggtacgcgggatatcaccattgacgctaacctgccagggctgcgcgtggatacggtagcgggcgatgatatcgtcaacagcattgaacacgggcaggcgctggtgatcactggcggcagtagcggcctgaatgcaggcgtgccattgacgatcacgattaacggcacggcttattccgccacggtacaggcagacgggagctggagcgtcggcattccggcgacaaacgtcagcgcatggcctgcgggggcgttaaccgttgacgtggcaggccagagcagcgccggaaatccggtcagcgtcagccatccgttcaccgtcgatttaacggcggtggcaatcagcatcaacaccgttgccagcgacgacgtaattaacgccgccgaaaaaggcaccgacctgaccctttctggcagcaccagcggaattgaaagcgggcaaaccgttaccgtcacttttggcggtaaaacctacactgcaagcgtcgccgccaacggtagctggagtgtgaacgttccagcggcagatctggcaactctgccagacggcgcggcgaacgtgcaggccagtgtcagcagcgcgagcggtaacagtgcctcggcgacccatgcgtacagcgttgacgccagcgcaccgacgctcaccattaacaccattgccagcgacgatattcttaacgccacggaggcgggaagcccgctcaccatcagcggcaccagcaccgccgaaaccgggcagacggtcaccgtaacccttaacggcgcaacctacagcggtaatgtgcaggcagacggtagctggagcgtcagcgttcccccttcagccttaggcgcgctgaccgcaagcaattacaccgtcagcgccacggtcaacgacaaagcgggcaaccccggcagcaccagccataatctggcggtagacaccaccgcgccggttctcaccattaacaccgtggcaggcgatgacatcatcaacgatgctgaacacgcccaggcgctggtgatttccggcaccagcagcggcggggaagcgggcgatgtggtgagcgttgtgctcaacggcaaaacctacacctccaccctggatgcctccggcaactggagcgttggcgttccggcggcggatgttacggcgctgggtagcggcgcacagaccatcaccgccagcgtcagcgatcgggcgggtaacagcgatgacgccagccgcaccgtgaccgtcagcctcagcgcgccagtgattagcatcaacaccatcgcgggcgatgatgtgatcaacgcgacggaaaaaggatctgatctgacgctttccggcaccagcgatcagcctgcgggtacggcgatcaccgttacgctgaacggacaaaactacagcgccaccaccgacgcctccggcaactggagcgttaccgtgcctgcctctgctgtcagtgcgctgggcgaagccacctacagcgtgacggcgagcgtcaccaatgctcagggtaacagcagcaccgccagccataacgtgcaggtcaataccgcgctgccgggcgtcaccattaatccggtggcgacggacgatattatcaacgccgctgaagcaggcagtgcgcaaaccatcagcggccaggtaaccggtgcggcggcgggcagcaccgtcaccgttgaactgggcggcaaaacttacaccgccacggtccaggctgatttaagttggagtgtgagcgtacctgccgccgactggcaggcgctgggtaacggtgagttaacggttaatgcctcggtgaccaacgccgttggcaacaccggtagcggcacgcgcgatatcaccatcgatgccagtctgcctggcctgcgggtggataccgtcgcgggtgatgatgtggtcaatatcatcgaacacagtcaggcgcaggtgatcaccggtagcagctccggctttgcggtgggcacggcgctgaacgtagtgataaataatcaaacttacgccgccacggtgctggcgaacggcagctggagcgtcggcgttcctgcgacggatgtcagtaactggcctgcgggaacgctgaatattaccgttagcggcgcgaacagtgccggaacgcaaaccagcattacccatccgctgaccgttgatctcaccaccgtcgccgtcagcataaacagcatcaccagcgatgatgtgattaacgccgccgaaaaaggcgcggcgctaacgctctccggcagcacgtccggcgtcgaagcggggcaaaccgttaccattacttttggcggtaaaacctacaccaccacggtggcggcaaacggtagctggagcaccaccgttccggcggcggatatggcggccctgcgtgacggcgatgccagcgcccaggtgcgggtgactaacgtcaacggcaacagcgccacggcaacgcatgaatacagcgtcgatagcgccgcgccaacggtcaccatcaacaccattgccagcgataacatcatcaatgccagcgaagcggcggcgggcgtaacggtgtccggcaccagcacggcgcaaaccgggcagacgctcaccgtcacgcttaatggcactaactaccagaccacggtgcaggcagacggcagctggagcttaacgctgcccgccagcgacttaaccgcacttgccaataacggctacaccctgaccgccacggtcagcgatttggcgggtaaccctggcagcgccagcaaaggtgtgaccgtcgataccaccgcgcccgtcatcagctttaacaccgtggcgggcgacgatgtgattaacagagttgaacacactcaggcgcagattatcagcggcaccgccacgggcgcggtggcgggcgaccgtctggtggtgaccatcgccgggcagcagtatgtcaccagcaccgatgccagcggcaactggagcgtcggcgtgcctgccagcgtgatttccggccttgcagatggcacagtgactatcagcgccactatcaccgatagcgcaggcaacagcagcacccagacgcacaacgtacaggtaaacacggcggcagtgtcgctctcggtcagcaccatcagcggcgataatattattaacgccgccgaagcgggcagtgcgctgaccctgagcggcaccggaacgaactttgccgcaggtacagtggtgaccgtgttgcttaacggcaaaggctacagcgctaccattcagaacaacgggagctggagtgtgaacgtgccggcggcagacgtcgcggcactggcggatggcaccagctacacggttagcgcctccgcccaggatagcgccggaaacagcgccacggcctcgcgcagtgtggcggtggatctcaccgcgccggttatcagcataaacacggtttcaacggacgaccgactcaacgccgccgaacagcagcagccgttaacccttaacggctcgaccagcgcggaagtagggcagacggtaaccgtcacctttggcggcaaaacttataccgccacggtggccgccaatggcacctgggcgctgaacgtgcctgcggcagatctggccgcgctcgggcagggcgcacagaccattaccgccagcgtgaacgatcgcgccggtaaccccggtcaaaccacgcacgccctgaccgtcgataccgttgcgccaacggtcaccatcgccacggtggcgggtgacgatattatcaacaacgccgaacagctcgctgggcaaaccatcagcggcaccaccaccgctgaagtgggccagacggtgaccgtcacctttaacggtcagagctggactgcaacggtcggcagcggcggaagctggtcggtgtttattccggcgcagcagtttgccggattaagcgacggcagctacaccattagcgcgacggttagcgatcaggccggaaaccctggtagcgccagccgtggcgtgacattgaacggcgacgtcccctccgtcaccatcaacacctttgcgggcgatgatgtggtgaatgcggcggagcacggctcgtcgctggtgatcagcggcaccaccaccgccccagtcgggcagacgctgaccctgaccttaaacggcaaaacctacactaccacggtacagaccggcggtagctggagctacaccctcggcagcgccgatgtcaccgcgctggcggacggcaatgcctacgtgattaacgcctcggtgagcaacgccattggcaacaccggcagcagcaatcacaccattaccgtcgacctcagcgccccggcgatgggcattaatatcgattccctgcaagccgacactggccttagctccagcgactttatcaccagcgtcagcccggtggtggtcaacggctcgctcaccgccgcgcttgccagtaacgagacggcgcaaatcagtatcgacggcggcgtaacctggaccacgcttaccgttaccggcacgacctggcgctataacgacagccgcacgctgaccgatggtaactatctctatcaggtacgggtgattgacgcagcgggcaacgtcggtgccactgacagccagaatgtggtgatcgacaccatcgcgccagatccagcagtaaaaaccatcgccatcagcgcgatcaccaccgatactggattgattactaacgattttgtcaccagcgacacgacgcttgcggtgagcggcacgctgggggcggcgctttctgccggtgagttcgcgcaaatcagcattgatggcggcaccacctggcagaatctttcggtaagcggtttgacctggacatatcttgacgggcgtacgctgactgacggcaactacaactatcaggtacgggtgatcgacaccgccggaaatatcggcgcgactgccagccagatagtcaccgtggataccaccgcgccgctggcgagcaaaaccatcgccattgcgggcattagcgatgacaccgggttaagcagcagcgattttgttactcgcgacactacgcttactgtgcgcggcacgctcggcgcggcgctggcggcagacgaacgggcgcaaatcagcctcgacggcggtgtcacctggaccacgttaaccgttatcggcaccagctggagctatgccgatggtcgcacactgaccgacggcacctggaactacacggtgcgggtggtggatctggcggggaacgttgggcagaccgcaacgcaaaacgtggtggtcgacaccaccagcccggaagcggcgaaaagtatcaccattaccggtatcagcgatgacaccggagccagcagcagcgattttattaccagcgacacctcgcttaccgtgcgcggcgtattgggggcggcgctcggcgctaacgaattcgcgcaaatcagtaccgacaacggcgcaacctgggtgaacgtgaccgtcgccgcagacggccttaactggagttacgttgacggacgcacgctcaccaacggcaccaccacctggcaggtgcgggtggtggatctggcgggcaacgttggcgcaaccggcagccagtcggcgcagattgacaccgtgaacccggcgcaggtactcaccatcgccagcatcagcaccgacacggggagttcggcaactgactttatcaccagcgatacctcgctcacgctgaccggttcgctgggggcggggcttgccagcggcgaagtggcgcagattagcctcgacggcggcgcgacctggatcacgctcaccaccaacggcacgcagtggacctacactgacagccgcacgctgaccgacggcagctacgtttaccaggtgcgggtgctggatctggcggggaatactggcccggtggtgtcgaaaacggtggtggtcgatacgattaaccccaccgcgacgccgaccattgtgtcgtacactgatgacgtcgggcagcggcaggggacattaagcagttcgcaggccaccgacgacactacgccgttgctgaacggcgtgctctccggcccgcttgccagcggtgaagtggtttacctctaccgtaacggcctgctgttaggcgcggtaacgatggtaggcgcactgaactggacctacagcgacagcgggctggtgagcggtgcctacacctacagcgcgcgagtggtggatctggcggggaatatcacctcctccagtgattttgtcctgatggtcgatacctctattccgaccacgctggcgcaaattaccagccagaccacgcgcgatactacgccgattatcagcggggtgatcaccgccgcgcttgccagcgggcagtatgttgaagtggtgatcaacggcaaaacctacacctctgaaccgggcggtgcggtggtggtcgatccggcgcacaacacctggtatgtacagttgccggataccgacgcgctggcggcttctgcgaccgcctataacgtcaccgcgcaggtaaaaagctcggcgggcaacggcaataacgccaatattagcaacggcacggtgacggttaacgcggcgattgattacacaccgacctggaccaccgccagcaaaaccaccgcctgggggctgacctacggcctcgacacgcacggaatgtggacggtgctggcaaaccagcaggtaatgcaatcgactgacccactcacctggtcgaagaccgcgctgacgctgtatcagagcggcaacaactacgccaccagctccatcgccgattacgaccgtaacggcacgggcgatctgtttatcacccgtgatgactacggtacaggctatatcaacggctttaccaataacggcgacggcaccttttccagcgctattcaggtcaccgtcggcaccctgacgtggtacggctcgattgtggcatttgataaagagggcgacggctatctcgacttctggattggcgacgcgggcgggccggactccaacaccttcctgtggaacaacgcaggtacgctggtaggtaactccactacgtcgaacagcggcggtagcgccacggtgggcggggcggtgacggggtatctttcgctcaacgaaggttctggcgtcgatctgaacaatgacggcaggatcgacctggttcagcacacctacaacctgaacaactattacacgctatcttcgctcatcaaccaggggaatggcacgtttgtctgggggcagaacaccaccaataccttcctgagcggggcgggtagtggcgctatgagcagcagcgtttctatgacctgggccgatttcgatggcgacggcgatatggacctcttcctgcctgccagccagggaagagctaactacggctcgctgttattcaacaccaacggcgtgctgggcagtccggtggcggtgggcgcaacggcaaccacctacgccagccagtttagcgtggcggtggactggaaccacgacggcctgatggatatcgcccgtatcgcccagaccggacaatcgtatctttacaccaacgttggtggtgccagcaactggacacaatcggccctcggcggcagccagagcggtaccaccagcggcgtggcggcaatggactacgactgggacggcgcggtggatgtactggtgaccaaacagtcgggcagcgtgttcctgatccgcaacaccaacacggtgagctacggcacttcgctacacctgcgcatcaccgatcccaacggcattaacgtctattacggtaataccgtaaaactgtataactcggcgggggtgctggtcgccacgcaaatcattaacccgcagtcggggatgggggttaacgacacctcggcgctggtcaacttctacgggctgaatgccggagaaacctacaacgcggtgctgatcaaatccactggcaccaccgccagcaatatcgaccagacggtcaacaccagctggggcggcttacaggccaccgatgccactcacgcttacgacctcagcgccgaagcaggcaccgcgagcaacaatggcaagttcgtcggcacgggctataacgacaccttctttgccaccgcaggtactgacacttacgacggctccggcggctgggtgtacagctccggcaccggaacgtggctggcaaacggcggcatggacgtggttgatttccgcctctcgacggtgggcgtgaccgcgaacttaagcagcaccgccgcacaggccaccggctttaacacctcgacatttaccaatatcgaaggcatttccggctcgaattttaacgacactctgaccggcagcagcggcgataaccaactggaagggcgcggcggcaacgacacccttaacatcggaaacggcggtcacgataccttgctctataaattgctcaacgccagtgacgctaccggcggcaacggctcagacgtggtgaatggctttacggtagggacatgggaaggcaccgccgacaccgatcgcattgatatccgcgagttgttacagggcagcggctacaccggcaacggcaaagccagctacgtcaacggcgtggcaacgctggatgcgcaggctggaaacatcggtgattttgtcaaagtcacccagagcggcagcgacaccatcgtgcagatcgaccgcgacggcacgggcggcacttttgcggcaactaacgtggtcacgctgacgggcgtgcataccgacctcgccactttgctggcgaatcatcagttgatggtggtgtagagaatgaaaaaaaatgcccagtccgtggaagcctggctggaggcgatgatcgccgtggcgcgttattaccgccttgatttttctcaggagaatgtgcgcgcgaccgtcaactgggagcgcgacagtaagcgggaggagttactcaccgacatggcgcggcagttggggatggggcttcggctggtggagttctccaccgactcgctcaacccgtggcggctgccgttgatcgccgtttttgataatcaacaaattggcgtgatcacccgccgtgacaatcacgacaatatcagcattcagtttagcggtgacgaagggctggaaactacgcttaacgtcgcggatgttgaggataaaatcgttgaactggcgctactgcgcccgctcagcgccatccctgacgcgcgggtagatgactatattcgcccgtatcaggcgaactggttctggagcctttcgctaaaagactggcggcgctacggcgatattatgctggcctcgctggtggcgaacgtgctggcgctggcggcgatgattttctcgatgcaggtttacgaccgggtggttccggcgcaatcgtacccgacgctatgggtgctgttcgccggggtgatgatggcgatcctgtttgagttctgtatgcgcatggtgcgcacacatctttcggatgtgatcggcaagcgggcggatctgcgcatttcggatcgcgtttttggtcacgcattacggctgaaaaataacgtgcgatcgaaatccaccggatcgtttatctcgcagatccgcgagctggaatcggtgcgggagctgattacttccaccaccatcggcgcggtggcggatctgccgttcttcctgctgtttgtctttattttatggatgatcggcggctggctggtgctggtggttttgctggcgctgccgttattggtgatccccggcctgctggtgcaacgcccgctggcgcggctggcgaacgaagggatgcgcgagtcggcggtgcgtaacgctacgctggtggaagccgtgcagtcgattgaagatattaagctgctgcgcgccgaacagcgttttcagaatcagtggaaccacaccaacgacgtggcctcgtccatcagcatgaagcaacgttttctcaccgggctactgctcacctggacccaggaagtgcagtccatcgtttacgtcgtggtgctgttggtgggctgctttatggtaatgaacggtgacatgaccaccggcgcgctggtcgggacgacgatcctggcttcgcgcaccatcgcgccgctgtcgcagatatccggcgtgctctcgcgctggcagcaggcgaaagtggcgcgcaacggacttgatgaactgatgaagcgcccggtggatcagccggaacacggcaaactggtgcataaagcggtgctacacggcaattatcagttcagcaacgctatcttttattacgatgaagaagagaaaattgccgatgtggcgattggcaaactcaacattcaggccggagagaaaatcgccattcttgggcgcaacggcgcgggtaaatcaacgctactgcaaatgctcgccggaatgcgtatcgcccagcaggggcaggtgctgctggataacatcagcatcggtcagcttgatccggcggatctgcgccgcgacatggggctgctgagccagaccgggagactctttttcggttcgctgcgggaaaacctgacgatggggatgccggaagccagcgatgaagatatcgaacgcgcgttaaccctcagcggggcgctgccgtttgtgcagaagcagaaaaacggcctcaactacatgattcaggaagggggatttggcctctctggtggtcagcggcaaacgctgctgctggcgcggctgctcatctctcaacccaatatcgtgctgctcgatgaacccagcgcctcgctggacgaaatggcggaagcgcatttaatcgaacaactgaaacagtggattggccatcgcacgctgattatcgccactcaccgcacggcgatgctgcaactggtggaccgcattatcgtgatggatcaggggcggattgtgatggatggcgcgaaagaggccattttgcgtgaacagagcgaacccacggcgcgacgggtggtgttgcaggagaagaataaggggtctgccgcatgaacggacaactgcaatacaaccgtggcctgactgaaccccgcttgccgcgttcggcgctggcggtacgcgttaccgctgtgatgctgctctgttttctcggctgggcgtggtacttccagcttgatgaagtcaccaccggcagcggcacggtagaaccctccgggcgcgaacaggtggtgcagtcgctggaaggcggaattctgtatcatctcgacgtcaaggttggcgatattgttgaacagggccagccactggcgcagcttaaccgcaccaaaacggaatccgacgtccaggaagcaatgtcgcggctgtacgcggcgctggcaacctcggcgcggctgcgggcggaagtgagtaataaaccgctggtcttccctgacgaactgaataaattccccgaacttatcgagtcggaaacggcgttgtacaacactcgccgcgatgggctgaacaaagccaccaccgggctgacgcaggggattagcctggtcaaccgcgaactggcgatgacccagccgctggtaaaacagggggcggcgagcagcgttgaagtgctgcgcctgcaacgccaggccaatgaactggaaaacaaactcagcgacgtgcgcacgcaatactacgttcaggcgcgcgaagagttagcaaaagccaatgcggaagtggaaacccagcgttcggtgatccgtggacgggaagactccctcacccggctcaactttaccgcgccggtacgtggcattgttcaggacattgacgtcaccacggttggcggcgttattgcccccggtggtaaactgatgaccatcgtgccgctggatgagcaactgctgatcgaggcaaaaatctccccgcgcgatgtggcgtttatccatccggggcaaaaatcgctggtgaaaataaccgcctacgattactccatctacggcggcctgccgggagaagtggcggtgatatcaccagacaccgtgcaggatgaagtacggcgcgatgtttattactatcgggtgtacattcgcactttcagcaaccatctggaaaataaaagcaaacagcagtttccgatattccccggtatggtggcgacggtcgatatccgcaccggcaaaaaaagcgtgctggattatctgttgaaaccctttaacaaagcacaggaggcgttgcgcgaacgatgaacattagcgatgtagcaaaaattaccggcctgaccagcaaagccattcgcttctatgaagagaaggggctggtgacgccgccgatgcgcagcgaaaatggttatcgaacctacacgcagcagcatctcaacgaactgaccttactgcgccaggcgcgccaggtgggctttaacctggaagagagcggcgaactggtgaatctgtttaacgatccgcagcgtcacagtgccgacgtcaaacgtcgcaccctggagaaagtggcggagatcgagcgacatatcgaagaactgcaatccatgcgcaaccagctgttggtgctggcgaatgcctgccctggcgatgacagcgccgactgcccgattatcgaaaatctctccggctgctgtcatcatcgggcggggtgaaaatcagttaatccccgtttgcaccgaaagaatatgctgcaaactttctaccataatgcgccccgactgaaataagccttcctggatttcgttgttaacattcacagcgtgaaccagggaggctaataacaccacttgcaagaaggcaaaaataaacgcaccgataatcataatatgcgtcagggggattttcctttgctctttcattttaaataacccacaaactgaccttccttcattaaggcgacttttcccgtgtggtgataaacaatgacgttataaagacctgactgataaacagtggcatctttattgtcttcatcaattgcacataatgaatcattgagataagcaaagttcttactgctcattctaaaggtcatgccaaatcctttataaatagattttttagcggcctgggcatgttgtgcggcttctgcatttttaaatgcctgcgcttctgatgcacttaaaatagccgcctgacgctgttgttctgcgagataacaggtgtcatggctgacgccctgcgcctggcaatctgcgatgcgggaagtgggtgaactacagccagccagtaatataaccgccagcagggaaaacgatttaatggagctattcatcattgttaaccttaaataatgtacggaaaattgcgaataagaaattgctgttaaaattagaacgaatatcccacgccgacacccgcaccgaaatcagattgtgtatccgcagaaatacctgctttaagtaccgtatgcgttccggcattaaaagatgttcctacagacaccgcagattcaccgttgtacgttcccgctcccgctgacaccatcatcaagtcaccggttttcacctgtggttgtgaggcgatagcgatggcagatgcagttcccgcattggcttctttacgattgtcctcaacttcgtttttcagagaatcgaaatggttattgagcgtagtaatctgctggctattatccgctactcgtttttgcgtgttgcttaactgctgatgcgtttgggttacgtcttgtgtcaggctgtcaatttgttcatgcgtttgtgttgagtcttgcgccagacgctgaatttgttccccgtactgcacactatcgatatgctgttgcgttgcctggttagtcgccagagtatctattttttgtttttgttctgctgcagtacgcgcattcgcatcattttgtgctctcagtccggcgttaaccatctcttgataatgtgcgttggtctgggcatcgccaagtgcggaaaccgttttttgcgtcgcgtcgatttgtttctgctgatcgtccatttgttgctgctgggtgtcagcttgtgcctgttgcgcattggcagcggctgtctgtctggcgtcaatcatgctctgatatcgggcggcagtctgcacatccccggtggcggcaacggttttccgggtttcgtcgagttgttgctgctggtcagcaatatcgctgcggttctgttcgatattatttttgttttctgtcacagcaccggaaagtttgacgccgttcatcagagcggtgttggcgttagcgttggcatggtcagccgttgactgggcatgtgcgacatcgccttttatgttggtgacgtctgactgcactgcggagacatcattacgggtgtcggcgatggcggctttattggcatcaatatccgtctgcgccaccataatggcgtgctgcgcgtcatcagctttcattgaagcccagttggcggcatgttgtgcgtcctgaatggcggtatcctgcccgttgtcgcggacgatctgtttttgctcgtttgatgccaacagtttctgctggtcggcaatatcgctgcggttctgttcgatgttgtttttgttttctgtcacagcaccggaaagtttgacgccgttcatcagagcggtgttggcgttagcgttggcatggtcagccgttgactgggcatgtgcgacatcgccttttatgttggtgacgtctgactgcactgcggagacatcattacgggtgtcggtgatggcggctttgttggcatcaatatccgtctgcgccaccgtgatggcgtgctgcgcgtcatcagctttcagtgaagcccagttggcggcatgttgtgcgtcctgaatggcggtatcctgcccgttgtcgcggtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaacccagttggcggcatgttgtgcgtcctgaatggcggtatcctgcccgttgtcgcggtcggtctgcgcttgattggttatcgggttcagcgtattggcgggctgtacgggagaggcagctgtattttcctgaggtgtcgttgtccggtaatcatgcgcaatcagataattttgtgcggctgcactattccctgtcctttctaaaaatcgaccaattttctgatcaatttccgattgcgacattcctggctggattgccgttaattctgtcgttgccgcctcaacagtatcacccgcaaacgcagatggacttaccgcggtagcaacaacgacagccagtaaagacagctttacagttttcatgcattttttctctttcaaagtaagtcacatatttgtttctataagcaacgtaaaacgttgttataagaattaatctgcgttgcaatttgatcgaaatctacgccgccatttgtgtgatgtaaagcgcatttttgtctggtgtaagcgtaaacatcaccaataagaaacaaaaaatgtttcttatataaataaaatcgaaaatcattttgtgctctttcaatgtaaaaaagagtaaagacttgttttgataagcgaaataaattctgtttctggactaaacgtgaagcggttcctgatgtgtgctaaaatgcgtttctttgataaatctcaatttttaagaggtttacgccaggcaggaaaatttaaatgaatgaatttgagaagatttttaatgaaatgaatctggaccgggcattgctaccgatcctttttcgttcgaaccggtcaacagtgtggaaatatttaagtggcgatagtacggctcctgcctcagctatgtcactgattatgctgttgcagttaatccagaaacgaaaccccgatctgttagccgaatggttaacgctttctgatttcaccattccgccagaagtttacctggaccagcctgattactggaaagggtgggtgtatacgcaacacaaggtcaataaaaacgtcctggaatatctaaaaaaacattatccggatgaagaccaaaaaaacatgaataaaggtagtgacgagtaatttgccaatgccagttaatatagcggaggcggcctacgattcgggcgcagacttccaggcatgataagacgcgcccgcgccgcatcaggcatcagcgcataaccgccggatgcggcgtaaacgccttatccggcctacaattcgggcatattttgtaggcatgaaaagacgcgtcagcgtcgcatcaggcgatgaccgcacggatgatcagcgttatcccttctatcgcaatgacttcaacatgcgtacctgcaccgagatcctcgctggcgctgacaggccatgaactgtcaccgacgcgcatatgacctcgcccgttgaccagcggagattccagcacaaaacgtcggccaataagctgctgcccgcgctggtttaaatgactgtcgctgtgcttttgttcgcgcacccgccgcgacaaccatttccaccacagccaggcggcgagcagcgtcaggacggcaaacatcaccccttgccactcccaacccagcggcaccagccagaccaccagaccggtaatcaccgctgccacgccgctccacaacaaataaccatttccgcccagcatctcggctgccagcagcaacccgccgagactgagccagaaaatatgtggatgaacgaccattaactccatcatggctgagtccgtttgttggcgctgtctttcaccagctcggcaatcccggcaatcgaccccatcaggctgctggcctctaatggcatcatcactactttgctgttactggaggaaccgatctgctgtaacgcttcggtgtatttctgcgctacgaagtagttcaccgcctgaatatcaccggaggcgatggcttcagacaccattttggtggcgcgggcttctgcttcagcggaacgttcacgagcttcagcctgtaaaaacgccgactgacgttcgccttccgctttcaggatttgcgactgtttttcaccttcggctttgaggatttccgcctgacggatcccttccgcttcgaggatgtaagcgcgtttggtacgttccgctttcatctgcgcgttcattgaagagataagctctgccggtgggcgcacgtcgcgaatttcaatacgggtgactttaatcccccacgggttggtggcttcatcgacaatacgcagcaggcgtgagttgatgctgtcgcgctgagagagcatttcgtcaagttccattgaacccaacacggtacggatgttagtcatggtcaggttgatgatcgccagctccagattgctgacttcataggcagcgcgtggcgcgtcaatcacctgaataaagcacacggcgtcgatggtaacgttggcgttatctttcgagataacttcctgggaagggatatcgagcacttgctccatcatattgatcttgcgaccaatgcgatccataaacggcaccaccagactgagccccggctgtaacgttttggtatagcgaccaaaacgttctactgtccactgatagccctgcggcacgattttgacgcccgcgccgacaatgaccagcgcgacaaaaatgagaatcgggataaagataagcatcggaaaaacctcctgttgtaccgtccataatcagcaaaattgctgcttgattaaacaaattatacctgattactgaaagagagttcccccttattcctgcgaaggataaactgtttttagtaaaaatcagaaaaagggaacagcgatgcaggaaaatagtcctttgcttcagctacaaaacgtaggatatctggcgggtgatgcgaagattcttaataacatcaatttttcgctgcgtgctggcgaatttaagttaattaccggtccttctggttgtggcaaaagtacgctgctaaaaatagttgcttcattgatcagcccaaccagcggaacgttactgtttgaaggtgaggatgtcagcacactaaagccagaaatctaccgccagcaagtgtcttactgcgcccagacgccgacgctgtttggcgatacggtatacgataatctgatctttccctggcagatccgtaaccagcagcctgacccggccatttttctcgattttcttgaacgtttcgctttgccggacagcattttgacgaagaatatcgccgagctatctggtggtgaaaaacaacgcatctcattgattcgtaacctgcaatttatgccgaaggttttattgctggatgaaatcaccagtgcgctggatgaaagtaataaacataacgttaatgagatgatccatcgctatgtgcgcgagcaaaatattgccgtgctgtgggtgacacacgataaagacgaaattaatcatgcggataaagtgattacactgcaaccgcatgccggagaaatgcaggaagcacgctatgaactcgcataatattactaacgaatcattggcactggcattaatgctggtggtggtggcaatcttaattagccataaagaaaaactggcgctggagaaagatattctctggagcgtcgggcgcgcgataattcagctgattattgtcggctatgtgctgaagtatattttcagcgtggatgatgccagcctgacattattgatggtgttatttatctgctttaatgcggcgtggaacgcgcaaaaacgcagtaaatatattgctaaagcttttatctcatcgtttattgccattacggtcggggcgggaattaccctggcggtgctgattctctcagggtcgattgaatttatcccgatgcaggtgatccctatcgccgggatgatagccggtaacgccatggtagcggtggggttgtgttacaacaatttagggcaacgggtgattagcgaacagcaacagattcaggagaaactgagtcttggcgcgacgccgaaacaggcttcagcgatattgattcgcgacagtattcgcgctgctttaattccgacggtcgattcagcaaaaacggtaggcttagtgagtttaccaggaatgatgtccgggctgatatttgccgggattgatccggtgaaggcgattaaatatcagattatggtgacctttatgctgctctcaaccgccagcctgtcgaccattattgcctgctatttaacctatcgtaagttttacaattcgcgccaccagttggtggtgacgcaattgaagaagaaatgatgcaatgccggatgcgcagcatcgcatccggcgttgtggttcatgtgccgatcaacggaaactcaatacaacaacgcatataactggcggcgatacttcgacgccagcgcatcacccgtacccagcgcagcgaggatctcctggaacgttttacgcgtctgaccgtctgcggcggtgagatctttacgcagatgcccgaacagcaactccagcgcctcttcattgcgcccaacctgatgcagttgcagcgccagttgcgtcgccagtgcggcatcttctggattttccgccacctgctgttgcaactgttgaatttccggcgtatcagccgcctgcttcagcagttcgatttgcgccaccagcccctggtagcgggtgtcctgatcctgtaacggaatggttttcagcacggcttcagcatcttcagaacggttcagcgcaatcagcgtttctgccagcagcaggccgatctccccgttctgattcgacaactgccaggcgtctttcagcaatggcagggcgtcggtgtaattgccttcttgcatcagttgcatcgcctgctgtgctttcagttcttcttcgcgcggcagcactttatccagcagggcgcggatcgcctcttccggttgcggcccctggaagccgtctaccggttgcccgttctggaacagatacacggtcggaatcgcgcgcagaccaaactgggcggcaatcatctgctccgcgtcgcagtccagcttcgccagaataaattgcccgttgtactgcgccgcgaggctttccagaattggggttaactgcaaacagtgctggctacgttcagaccaaaaatagaacagcaccggagtggtcatcgactgttcaagaacctgttgcaggttagattcgttaatgttgacaatattttctacggacatggagtcgctctctgttgtcgatattttctttgacatgggggcttaagcgcgcgcttcaactcacccctgcaatattttgtccatcacgcgccccggcagcaggcgcttaagcaccattactgcccaggtcaccagcgttaccggatagcgcatcttcggtttctcgctaataaaagcatggcgtactttgtcgaccaccgcttccggtcccaacgtaaagcgggcggcgatgccaggattttcgactggtttatcactttgcgtctggttgacgttgtcggtgaagcgagtacgaatgggaccgggttcgatcaggctaactttaactccgctgtggcgcagctccatgcgcagcgcatccgaccacgcctccagcgcatatttactggctgcgtaagcgccgcgacccggcgtggagattaatcccatcaccgatgaggtcatcacaatacgcccttcaccgtgcggtaacatcgcgggtaacaggcgcatggtgagctggtgagcgccgaaaaagttggcagaaaactgctgttccatctgcgcacggctgatggtggaaagggggccatacatgccgaatccggcattgttaaagatcccatacagacaattatcggtcagggcgatcacttcgtcggctgcgcgatcaacactttctggtgaatccagatcgatcaacacgccggtaaatcccatgctgttcatgcgctcaacatcatccggtttccggcaacctgccagcacatgaaaaccctggcgttttaattcgagcgcgctttccaggccaattccactggaacatccggtaattaagaccgatttttgcataactttacctgtcaggatctccgttgctttatgagtcatgatttactaaaggctgcaactgcttcgccatccagtcggcaataaacggctgggcgtcgcggttgggatgaataccgtcatcctgcatccattgtggcttgaggtagacctcttccataaaaaagggcagcagcggaacatcaaactctttggcgagtttggggtaaatggcgctaaaggcttcattataacggcgaccatagtttgcaggcagacgtatttgcattaacaatggttcagcgttggcggctttgacatcctgcaaaatctggcgcagcgtctgctcggtttgttgtggctgaaaaccacgcaaaccgtcattgccgcccagttctaccagcacccagcgcggctgatgctgtttcagcagagccggaaggcgcgccagcccttgttgcgaggtgtcgccgctgatgctggcattgactaccgacgttttattctgccacttatcattcaacaaggcaggccaggccgcgctggcagacattcgatacccggcgctcaggctatcacccagaatcaataacgtgtccgctgcggcggcacggaaggttaacaggaccaggaacaggaagggcaaatgccagcggaaaacattgttgaagttcatcatcttaagaagtccgtcggtcagggggagcatgaactctccatcctcaccggagttgagctggttgtcaaacgtggcgagaccatcgcactggtgggcgagtcgggatcgggtaagtcaaccttgctggcgatcctcgccgggctggatgacggcagcagtggcgaagtgagtctggtgggacaaccgctacataatatggacgaagaagcgcgggcaaagttgcgcgcgaagcacgtcggctttgtttttcagtcatttatgttaattcctacccttaacgcgctggaaaacgtcgagcttccggcgctgctgcgcggtgagagtagcgcggaaagtcgtaacggagcgaaagcgttgctcgaacagttagggctgggtaaacgtctggatcatcttccggcacagctttccggcggtgaacagcaacgagtggcgctggcacgagcctttaacggtcgacctgatgtgctgtttgccgacgaacccaccggcaaccttgaccgccagaccggcgataaaattgccgacctgctgttttccctcaaccgtgaacatggcaccacgttgattatggtgacccacgacctgcaactggcggcacgctgcgaccgctgcttacggctggtgaacgggcagttgcaggaggaagcatgattgcacgttggttctggcgcgaatggcgttcgccgtcgctattaattgtctggctggcgctaagcctggcggtggcctgcgtgctggcgctgggcaatatcagcgatcgcatggagaagggcttaagccaacaaagccgggagtttatggcgggcgatcgggcgttgcgcagttcgcgcgaagtgccgcaagcatggctggaggaagcgcaaaagcgcggcctgaaagtcggcaagcagctgactttcgccaccatgacatttgcaggcgacacaccgcagctggcgaacgttaaagcggtggatgatatctacccgatgtatggcgatctgcaaaccaatccccctggcctgaaaccgcaggcgggcagcgtattgctggccccacgcctgatggcactgcttaacctaaaaacgggcgacaccattgacgtgggcgatgccaccttgcggattgccggagaagtgattcaggaaccggattccggttttaaccccttccagatggctccgcgtctgatgatgaatctggcggatgtcgataaaaccggagccgtgcagccggggagtcgggtcacctggcgctataaattcggcggcaacgagaaccagctcgacagctatgagaaatggttgttacctcagcttaaacccgaacaacgctggtacggtctggaacaggacgaaggcgcgctggggcgctcgatggaacgctcgcaacagttcctgctgctttcggcgcttctgaccttgctgctggcagtggcagcggtggcggtggcgatgaatcattactgtcgcagtcgctacgatcttgtggcgatcctcaaaacgctgggggcagggcgagcgcaactgcgtaagctaatcgtcggtcagtggttgatggtgctgacgctttcagccgttaccggcggggcgataggcctgttgttcgaaaacgtgttgatggtgctgctcaagcccgttttgcctgctgcactaccgccagccagcctctggccgtggttgtgggcgctgggcaccatgacggtcatctcgctgctggtggggctacgaccgtaccgcttgttgctggcaacccagcctttacgcgtattgcgtaatgatgtggtcgcgaacgtctggccgctcaagttttatctgccgattgtcagtgtggtggttgtgctgctgctcgccggattaatgggcggcagtatgctgctctgggcggtgctggcgggcgcggtagtactggctttgctgtgcggtgtgctgggctggatgctgctgaatgtacttcgccgcatgacgctgaaatcgctacctctgcgcctggcggttagccgcctgttacgtcagccgtggtcaacgttaagccagctttcggcattttcgctctcctttatgctgctggcgctgttgctggtattgcgtggcgatctgctcgaccgctggcaacagcagctaccgccagaaagcccgaactactttttaatcaacatcgccacagaacaggtagaaccgctaaaagcgttcctcgcggaacatcagatagtcccggaatcattttatccggtggtgcgggcgcgactgacggcgattaacgacaagccgacagaaggcaatgaagatgaggcgcttaaccgcgaactcaatcttacctggcaaaatacgcggcccgatcataatccgattgtcgccggtaactggccgccaaaagccgatgaagtgtcaatggaagaggggctggcgaaacgcttaaacgttgccctcggcgataccgtgacttttatgggcgatacccaggagttccgcgctaaagtgaccagcctgcgcaaagtggactgggaaagtctgcggcctaatttctattttattttccctgaaggggcattagacggacaaccgcagagttggcttaccagtttccgctgggagaatggcaacggcatgttgacgcaactcaaccgccagttccctaccattagcctgttagacattggcgcgattttaaaacaggtcggtcaggtgctggagcaggtaagtcgggcgctggaagtgatggtggtgctggtcaccgcctgcggtatgttgctgttgctggcacaggtgcaggtgggaatgcgtcagcgtcatcaggagctggtggtgtggcgcacactcggtgcgggcaaaaaactgctgcgcacgacattgtggtgtgagttcgccatgctcgggtttgtatccggcctggtggccgcaattggtgcggaaacggcactggcggtactgcaatcgaaagtgtttgatttcccgtgggagccagactggcgattgtggattgttctgccgtgcagcggtgcgctgctgctgtcgctttgcggcggctggctgggtgcgcgactggttaagggtaaggcgctattcaggcagtttgtgggatgatgacaggcgttagattgcctgatgcgctacgcttatcaggcctacgaggatcgtgcaatatattgattttgcaagattgtgtaggccggataaggcgtttacgccgcatctggcatgaacagtgtgcattttggcaataaatatgaaaccaactgtcatgtcggtttttttaaaggccgaaggtggtaaaccttcggccttagctacgtttcctcagttattcaataaactgacggatcagttccagcagcgcgattagcgccttaagaacgatgagaactgcctctctccaaattagagcaccagaatcagcaccacctgtatcctgaccaggacttaaaagtacttttccgcactgcggtaatcccttgaggcagtatcactactagcgtcgggattgtatcgccaacatagctgtttgaatatgtaggcatcctgacttataattcatttgctagatgaggactgtttcatttctgcccggaaccaccaagtcttgggcggaaaaaataaaaaaaccgactgtcatgtcggtttttttatatctgtattctggtgcaaccattctgttctcacgacaatcgccgtttcagaataccgcccatcactgcgccttaacccattccgccacttccgcccactcaccgcgaaagacaactttttcagcttttttctcaagctgatagcgatacatcgggtcgtaatattcttcaagtaacggcaccagccaggccagatgaccgtcggtgctgccggtggtgagttgcgttgtcagcgccgtatccagctgggcagcgagttcgttatagcgctgtaaccccagccgacgcttaatcgccgaaagtccgtgatgcaggtattcgcaatactcctgccagccctgttcgtcgccgtacgcgtgggtaaaatcatgatgcatacgcaagaaatactcttcgttcaggcgttcaagacggatctcaaacggatcttctaccaccgcaatcgccgcctgagtcattcgctcgcgcagacattccggcaggtgatttgaaccgatcatccggctttcatcttccagcacccacaggcgcagctcctgacgggcgtcggtttttagcatttcggcagccagcagattttcaaaactcgcctggctaagttgcggttgcaacgtgcgaccaaacgccgaaccgcgatggcgcgccagcccttccagatcaacaccgttcggctgttgctgcactaacagcgttttaccgctgccagtacaaccgccaatcagcactatcggtttttgtgacagttcaatggtcgcctgaatcgcggtctggcgcagtgccttataaccgccgtctaccagcggataatcaatccccgcttcatgcaaccagcgttgcacaatatgtgaacgttgaccgccgcgggcgcagcagagaataccttgcggattttgcaggcacgctgcccgccaggcgtccatgcgctgctgacgaatttcacccgccaccagtttatgccccagcgccagcgccgcgtctgagccttgctgtttatagcaggtgccaacggcggcacgttcatcgttattcattaacggcaggttgatagcggcgggcattgcgccttgctcaaactcgataggggcgcgaacatcaataatgggcgtatcagcaatcagcagggcacgatagtcctgttccgtgtgtctctcttgcatagttaaaagtgaacctcaaatcagcttgcgcgctattttacgcgccaacgcgcaaggaaacttgatttttaactgcgtgggttgccgaaaatttctaaaaatccgctgatttccggcctgcgctgggtaaacaaggtcacaatatcttctaccgctttgccgctgccaaatttgcgccatgccagactcaatggcgaaggagggcgcatcgttgggattacccggctgaccagttgttgattatcgatcattgactggcaaagtgattttggcaaaaaaccaatgccaacgcccgccagatgggcggcgattttcgtttccatatcgggaacaataatctctttttgccccggcaatcgccaggcgacgcgtttggttagtgttcgggcgctgtcttcaatattgaccgccggaaagcgccgcaactgtgcttctgttagcggctcttcaacgttcgccagcggatgatccgccgccatgacaaagcgccattgcaccgatcctaagggatcaagactaaaggtatttgccagcgcctcggttcccgtgacgccgatagccagtgaaaaaccttcgtacaatagcgagtcccagacgcccatatagatttgtcgggagatgtgaaactgggtaaacgggtaacgttcattcagccacgccagcagctgggcgacggcctggggggtgtagagcaggttgttgatgacaatattcacctggcgttccacgccatcattcacctgttgcagctcgctgggcatactttccagccagctcagccagtctctggcctgggaaagtagatgctcgccagccgctgtcaacgtcacgctgcgagtcgtgcggaaaaacagcgccactccggtattctcttccagaagtttaatgcgataactgatcgtcgccgtggttttacacaatcgttctgccgcttttgaaaaacttcctgtttcagcaaccgcaatgaaagtccgcaaggtttctggatcgaacatcttcaggtatccccttttaaatccgcaagttgcgtgattttcttatcctctgatttatcagtatttttacatgataaccctgttcaatttgtggactaaatctagttttggaaaaatattccaacttttgtgttgatgttgttctcttaaggttttagattgcctgttattgaaaccaagctgaccggtcggcggtggttgaacggaattatgttataaggacaaaaagatgaaacttcaggtattaccgttaagtcaggaagcctttagtgcttatggcgacgtaatcgaaacgcagaaacgggattttttccatattaacaatggactggtggagcgttaccacgatttggcgctggttgagattcttgagcaagaccgtacgcttatcagcattaaccgcgcgcaaccggcgaatctgccgctgaccattcacgaactcgaacgtcatccgctgggtactcaggcctttatcccgatgaaaggtgaagtgtttgtggtggtcgtggcgttaggtgacgacaaaccagacctgtcaacgctgcgggcgtttattaccaacggcgaacagggggtgaattaccatcgtaacgtctggcatcatccacttttcgcctggcagcgcgtcaccgattttctgaccatcgatcgcggcggcagtgacaactgtgatgttgaaagtattcctgaacaggaactctgttttgcgtgacgcctgcaaccgacttgcataagataaactaattgttcattgtttatgctcacttgtaggtcggagttaacgtaggtatgacggaagttagacggcgcggcaggccaggacaggcggagcctgtggcacagaagggcgcacaggcgttagagcggggaattgcgattctgcaatatctggaaaaaagtgggggaagttcgtcggttagcgatatctctctcaatctggatttgccgctctccacgacctttcgcttgctgaaggttttacaggcagcggattttgtctatcaggacagtcagttaggctggtggcatataggattaggtgtctttaacgtcggtgcggcgtacatccataaccgcgatgtcctctccgtcgccgggccgtttatgcgccgcctgatgttactttccggcgaaacggtcaatgtcgcgatccgtaacggtaatgaagcggtattaattggtcagttagagtgtaaatcgatggtcaggatgtgcgcgccactgggcagtcgtctgccgctgcatgcttccggtgcgggcaaagcgctgctttatccgctggcggaagaggagttgatgagcatcattctgcaaaccggtttgcagcagtttacgccaactacgcttgtggatatgcccaccttgctgaaggacctggaacaagcgcgtgaactgagctataccgtagataaagaagagcatgttgtcggcctgaattgtatagcttcagcaatttacgatgatgtaggtagcgttgttgccgctatctccatctccgggccttcatcaagactgacagaagatcgttttgtcagtcagggtgagctggtcagagacaccgcccgcgatatcagcacggcgttgggactgaaagcacatccatagtgtctgtcgcatcccgctctgcggagcgggtttttttgacaaaatttgaaagttggaaaatttttccaattaatagaggtaggaataaaatggcaaaaatgagagccgttgacgcggcaatgtatgtgctggagaaagaaggtatcaccaccgccttcggcgttccgggagctgcaatcaatccgttctactcagcgatgcgtaagcacggcggtattcgtcacattctggcgcgtcatgtggaaggtgcttcgcacatggcggaaggttatacccgcgcaacggcagggaatatcggcgtatgtctgggaacctcgggaccagcaggcactgacatgatcaccgcgctctattccgcttctgctgattccattcctattctgtgtattaccggtcaggcaccgcgcgcccgtctgcataaagaagattttcaggccgtagatattgaagcaattgctaaaccggtcagcaaaatggcggttacagttcgtgaagcggcgctggtgcctcgtgtgctgcaacaggcatttcacctgatgcgttctggtcgtccggggccggtactggtggatttaccgtttgacgtacaggttgcggaaatcgagtttgatcctgacatgtacgaaccgctgccggtctacaaacctgcagccagccgtatgcagatcgaaaaagcggtagaaatgttaattcaggccgaacgtccggtgattgttgccgggggcggggtaatcaatgctgacgcagctgcactgttacaacagtttgctgaactgaccagcgttccggtgatcccaacgctgatgggctggggctgtatcccggatgaccacgaactgatggccgggatggtgggtctgcaaactgcgcatcgttacggtaacgcaacgctactggcgtccgacatggtgtttggtatcggtaaccgttttgctaaccgtcataccggttcggtagagaaatacaccgaagggcgcaaaatcgttcatatcgatattgagccgacgcaaattggccgcgtgctgtgtccggatctgggcattgtctctgatgctaaagcggcgctgacgctgctggttgaagtggcgcaggagatgcaaaaagcgggtcgtctgccgtgtcgtaaagaatgggtcgccgactgccagcagcgcaaacgcactttgctgcgcaaaacccacttcgacaatgtgccggtgaaaccgcagcgcgtgtatgaagagatgaacaaagcctttggtcgcgatgtttgttatgtcaccaccattggtttgtcacaaatcgctgcggcacaaatgctacatgtctttaaagaccgccactggatcaactgtgggcaggcaggcccgttgggctggaccattccggcggcgctgggcgtgtgtgccgctgatccagagcgcaatgtggtggcgatttccggtgacttcgacttccagtttctgattgaagaattagccgttggcgcacagttcaacattccgtacatccatgtactggtcaataacgcctatctgggtctgattcgccagtcgcagcgcgcgtttgatatggattactgcgtacagctcgcgttcgaaaatattaactccagcgaagtgaacggttacggcgtcgaccacgtaaaagtagcggaaggtttaggttgtaaagcgattcgcgttttcaaaccggaagatatagcaccagcctttgaacaggcgaaagccttaatggcgcaatatcgggtaccggtagtcgtggaagttattctcgagcgtgtgaccaatatttcgatgggcagcgaactggataatgtcatggaatttgaagatatcgccgataacgcagtggatgcaccgactgaaacctgcttcatgcactatgaataagggagataaataatgttacgtttctctgctaatttatcgatgttatttggtgaatatgattttctcgcccgttttgagaaagctgcgcagtgtggttttcgcggcgttgaatttatgttcccttatgactacgacattgaagaattaaaacaggtgctggcgagtaataaactcgaacatacgctgcacaatttaccggcaggtgactgggcggcgggcgagcggggtattgcctgtattcctggccgtgaagaagagtttcgggatggcgtagcagcagcgattcgttatgcccgtgcgctgggtaataaaaaaattaactgtctggtcggtaaaacgccggctggtttcagcagtgaacagattcacgcaacgcttgtagaaaacctgcgttatgccgcgaatatgctgatgaaagaagatattttattactgattgaacctattaaccattttgatattcctggtttccatctcaccggaactcggcaggcactgaaactgattgatgatgttggttgctgcaatttgaaaatacagtatgacatttatcacatgcagcggatggaaggtgaattaaccaacactatgacgcaatgggccgataaaattggtcacctgcaaattgctgataatccgcatcgcggcgaaccggggaccggagaaattaattatgattatctctttaaggtaatcgaaaattctgactacaacggttgggttgggtgtgaatataaaccccaaaccaccacggaagccggtttacgctggatggatccgtaccgttaaaacgtaacgctattcagacaatgcttttttaggccgctaagttggcaggggatcgtgttgtctgaattcaggaaaagcgaaatttaaaagaggttaattatgaaactgggatttattggcttaggcattatgggtacaccgatggccattaatctggcgcgagccggtcatcaactgcatgtcacaaccattggtccggttgctgatgaattactgtcactgggtgccgtcagtgttgaaactgcgcgccaggtaacggaagcatcggacatcatttttattatggtgccggatacgccacaggttgaagaagttctgtttggtgaaaatggttgtaccaaagcctcgctgaagggcaaaaccattgttgatatgagctccatttccccgattgaaactaagcgtttcgctcgtcaggtgaatgaactgggcggcgattatctcgatgcgcccgtctccggcggtgaaatcggcgcgcgtgaagggacgttgtcgattatggttggcggtgacgaagcggtatttgaacgtgttaaaccgctgtttgaactgctcggtaaaaatatcaccctcgtgggcggtaacggcgacggtcaaacctgcaaagtggcaaatcagattatcgtggcgctcaatattgaagcggtttctgaagccctgctgtttgcttcaaaagccggtgcagatccggtacgtgtgcgccaggcgctgatgggcggctttgcttcctcacgtattctggaagttcacggtgagcgcatgattaaacgcacctttaatccaggttttaaaattgcgctgcaccagaaagatctcaacctggcactgcaaagtgcgaaagcacttgcgctgaacctgccaaacactgcgacctgccaggagttatttaatacctgtgcggcaaacggtggcagccagttggatcactctgcgttagtgcaggcgctggaattaatggctaaccataaactggcctgatacccgcaataaaaatggccgatatcagaaaatgaatcggccagcaatattaaaaaaagaaagcagccaaagatgttgcttcagtattaaaaataatatttttattttatttgttcctcatagctagattaaaacagcgttattcgatacgtgaaattaagagggatttatggaacatcagagaaaactattccagcaacgcggctatagcgaagatctattgccgaaaacgcaaagccagcggacctggaaaacatttaactattttaccttatggatgggttcggttcataacgttcccaattatgtgatggtcggcggcttttttattctcggcttgtctacctttagtattatgctggcaattatcctcagcgcctttttcattgccgcggtaatggtattaaacggtgctgcgggcagtaaatacggtgtgccttttgccatgatcctgcgtgcttcttacggcgtacgtggtgcactgtttcccggattattaagaggcgggattgctgccattatgtggtttggcctgcaatgttacgctggatcgctggcctgcttgattctgattggcaaaatctggccgggatttttaactctcggtggtgattttaccctgttagggctttctctaccgggcttaatcactttcttactcttctggctggtgaacgtcggaatcggtttcggtggtggcaaagttttaaataaattcactgccattcttaacccgtgcatctatatcgttttcggcggtatggcgatttgggcgatttcgctggtcgggctcggtccaatctttgactacattccgagcggtattcagaaagcagaaaacagtggcttcctgttcctggtggtgattaacgcggtagttgcggtctgggcggcaccggcggtgagcgcatccgactttacgcaaaacgcccactcgtttcgtgagcaggcgctggggcaaacgctcggtttagttgtggcctatattctgtttgcggtcgccggggtatgtattattgccggagccagtattcactacggcgctgacacctggaacgtgctggatattgttcagcgttgggatagcctgtttgcctcgttctttgcggtactggttattctgatgacgactatctccactaacgccaccggtaatattattcctgctggttatcagattgccgctattgcaccgacgaaactgacctataaaaacggcgtactgattgccagtattatcagcctgctgatctgcccgtggaaattaatggaaaatcaggacagtatttatctgttcctcgatattatcggcggaatgctgggtccggtaattggtgtcatgatggcgcattattttgtggtgatgcgtgggcaaattaatcttgatgaactgtacaccgcacctggcgattataaatattacgataacggttttaacctcactgcgttttcagtaactctggtggccgttattttatctcttggcggtaagtttattccctttatggaaccgttatctcgtgtttcatggtttgtcggcgtcatcgtcgcctttgcggcctacgccttattaaagaaacgtacaacagcagaaaaaacaggagagcaaaaaaccataggttaattaatcccgatattgaacattgagttaaaaaccaatctgtattttacaaggagtttgttatgtcttttgatttaatcattaaaaacggcaccgttattttagaaaacgaagctcgcgttgtagatatcgccgttaaaggcggaaaaattgctgctatcggtcaggatctgggcgatgcaaaagaagttatggatgcgtctggtctggtggtttcgccaggcatggttgatgcgcacacccatatttctgaaccgggtcgtagccactgggaaggttatgaaactggtactcgcgcagcggcaaaaggtggtatcaccaccatgatcgaaatgccgctcaaccagctgcctgcaacggttgaccgcgcttcaattgaactgaagttcgatgccgctaaaggcaagctgactatcgatgcggcacaactcggtggcctggtgtcttacaacatcgaccgtctgcatgagctggatgaagtgggcgttgtcggcttcaaatgcttcgttgcgacctgtggcgatcgcggtatcgacaacgacttccgtgacgtcaatgactggcagttcttcaaaggtgcgcagaagctgggcgaactggggcagccggtgctggtgcactgcgaaaacgcactgatctgtgatgcactgggcgaagaagcgaaaagtgaaggtcgcgtaactgcccatgactatgtggcttcgcgtccggtatttaccgaagtggaagcgattcgccgcgtactgtacctggcgaaagttgccggttgccgtctgcacatttgccatatcagcagcccggaaggcgttgaggaagtgactcgtgcacgtcaggaaggtcaggatgttacctgtgaatcctgcccgcattactttgtactggataccgaacagttcgaagaaatcggtactctggcgaagtgttcaccgccgatccgcgatctggaaaaccagaaaggcatgtgggaaaaactatttaacggtgaaatcgactgcctggtttccgaccactcaccatgccctccggaaatgaaagccggcaacatcatggaagcatggggcggtattgccggtctgcaaaactgtatggacgtgatgttcgatgaagcggtacagaaacgcggaatgtctctgccaatgttcggcaaattaatggcgactaacgcagcagatattttcggtctgcagcaaaaaggccgtatcgccccaggaaaagatgccgacttcgtcttcattcagccgaatagcagctatgttcttaccaatgacgatctggaatatcgccacaaagtcagcccgtatgttggccgtaccattggcgcgcgtatcacgaaaaccatcttacgtggtgatgtgatttacgacattgaacagggcttccctgttgcgccgaaaggtcaatttatccttaaacatcagcagtaatctggcccctgcaatgcccgtccttgcggcgggcattctccggttaaggtgtgtttatgttcaattttgcagtcagccgcgaaagcctgttatcaggatttcagtggtttttctttattttttgcaacactgttgtggttcctcctacgctactttctgcttttcagttgccgcaaagcagcctgcttacgctcacgcaatatgcttttcttgctaccgcactggcctgcttcgctcaggcgttctgcggtcatcgtcgcgctattatggaagggccgggtggcctgtggtggggaaccatccttactatcacccttggcgaagcatcgcgcgggacaccgatcaacgatatcgctaccagtctggcggtggggattgcgctctccggcgtgctgacgatgttgattggttttagcggattaggtcatcgcctggcgcgattatttacgccgtcggtgatggtcctgtttatgttgatgctgggcgcacagctgaccactatctttttcaaaggtatgctcgggctgccgtttggcatagccgacccgaattttaaaattcagttaccgccgttcgcgctctcggtggcggtgatgtgcctggtactggcgatgattattttcctgccgcaacgttttgcccgttacggcctgctggtcggcacgataaccggctggttgttgtggtacttttgctttccttcttcgcattcgctctccggtgagttgcactggcagtggttcccgctcggcagtggaggtgctttgtcgccggggattattctgacggcggtgattacaggtctggttaatatcagcaatacctacggtgcgattcggggcacggatgttttttatccgcagcagggcgcggggaatacgcgttatcgtcgtagctttgtggcgaccggatttatgacgctgataaccgtaccgctggcggtaattccattttcaccgtttgtttcatccattggtttattaacccagactggcgattacacgcggcgttcgtttatttatggcagcgttatttgcctgctggttgcactggttccggcactcactcgactgttttgcagtatccctttacccgtgagtagcgcggttatgctggtttcttatctgcctttactcttttccgcgctggtgtttagccagcaaatcacgtttaccgctcgcaatatttatcgactcgcattgccgttatttgtcggcatatttttaatggcattaccgcctgtgtatctgcaagaccttccattaacgcttcgtcctctgctcagtaacggcttactggtcgggattttactggctgttcttatggataatcttattccgtgggaacgcatcgaataatttgttgaaaaaggattgataatgaagattgtcattgcgccagactcgtttaaagagagcttaagtgcagaaaaatgttgtcaggcaattaaagccgggttttcgaccctctttcccgatgcgaactatatctgtttgccgatagcggatggcggcgaagggacggtggatgcgatggtcgccgcgacgggcggcaacatcgtgacgcttgaagtctgcgggccgatgggcgaaaaagtgaatgctttttatggccttaccggcgacgggaaaacagcggtgattgagatggcggcagcaagtggtctgatgctggtcgcgcctgaaaagcgtaatccgttgctggcctccagttttggtacgggggagttaattcgtcatgcgctggataacggcattcgccatattattctcggcataggcggcagtgcgacggtcgacggtggtatgggcatggcgcaggcgcttggtgtgcgtttccttgatgccgacggtcaggtgctggcggctaacggcggcaatttagcacgcgtggcaagtattgagatggatgaatgcgatccgcgtctggcgaactgccatattgaagtagcatgtgatgttgataacccgctggtggggccacgcggtgcggcggcggtgtttggtccgcaaaaaggggcaacgccggaaatggtcgaagagctggagcagggactgcaaaattacgcccgtgttttacaacagcaaactgaaatcaacgtctgccagatggcgggcggcggcgcggcgggcgggatgggcattgcggcggcggtattcctcaatgcggatattaaaccgggtattgagattgtactgcgggcggtcaacctggagcaggcggtgcagggcgcagcgctggtgatcaccggggaagggcgcatcgactcgcaaacggcaggcggtaaagcaccgctgggcgtggcgtcggtggcgaagcagtttaatgtcccggtgattgggattgctggcgtattgggtgatggcgtggaagtggtgcaccagtacggcattgacgcggtgttcagcattttgccacgtctggcacctttagccgaagtgctcgccagcggtgaaaccaatctcttcaacagcgcacgaaatattgcctgcgccattaaaataggtcagggaattaaaaactgactcttgccattagagcggatgcattttatcccgcatccgttttttacctgaatttaccgcaaaaaaagccacggtataaaccgtggcaaaatccaacatagctaaaaataatcaggcgagtggtatgacttaaatctctacgtcgcggttgcaatctttcgagtaaatataactaaacgcttcaccacgccctacgccataaccggcctgtaaggaataagcgcccatgaagatgtaatcgccttttttcaccgggatccagttattgtcgaggttataaaccccctgaccggaaagaatataggcaccgtgttcctggacgtgagtttcgatataaccgtggctggcacctggcgcaaaagagaggatatgcatgttcatatcaaaacctaactctttgggcagaaaatctagcagaataacatcgtccatgccttcataatgaatgcgttcgagttcgctggcattgccagaaaccagccacggtgcatggccttctaccggaacatagcggcgcttatataaaaagatttggctgtcttcggcctgggcgttaacaaacgtcattaaggagcctggtgggcaataaagatagccaccttcgcttaaggcaaatgttttgccttcagctttggcagtgatatttccagagatcacatacaggaacgtttcaatgccttcgccaccgaagccctgttggttgccaccgttttgatgcagtgtgaccagataatcaacaaaagaggcacccagctttggcgtggagaggattgtcgcgtcacaattttcaaagcccggaataatattttttaccagaccatccggggttaaaagtgcgaaattaccgtgtttaacaatcgcacggttagccagtaaatcatcgcggtaaccggtgacgttatttaaatatcccatttatgactccttatttctgccaggcaagttgataaagcatgagtgccaacgttttgaccccttcggcaaggtcggtaatattggtgcgttccgccgggttatggctgatcccgttgatgctggggataaaaatcatgcaggttggtacgcgaggcgcgaaaatttgcgcgtcgtgcccggcaccactgtgcatcacccggtaattcagtttttcactttcacacaattctgtcagggtggcgaccagttccttgttcatcggcacgggttcttcgtccatccataaatcgatatcaataccaatgtccatttcatcgcaaatcgcccgcatgtcgttttctaactgttgggtgaaatcgcgcagcacggcagcatcggtatggcgacaatcaatggtgaacgtggttttacccggcaccacattcaccgtattcgggcgcggctccaccttaccaaaggtcagcaccagcgggtcgcccatctttttcgctttttcgacagactgatggcaaatgcgactgaaagcgtaaaccgtatcacgacgataacccatcggcgtggtgcctgcatggtttgattcgccgttcagcgtcaccgtatagcgacgctgcccgacaattgcattcaccacgccaattgattgaccattactttccagcacacagccctgttcgatatgcagttcgacaaaggctttaatatcctgacgcggagttagtggggcgttcggcagagtaaatccgcaagccttcatcgcatcgacaaaactatttcctttggcatcacagatattccgcacgtcgtcaggattcgccagcccaaagatatttttactgccccagaagacatacgggaagcggctgccttcttcttctgccatcgccaccacttcgaccgtacgtaacggcgcgccgtattgcgttttcagccagtcaattgccagccacgccgccagcgcgccgaattgcccgtcgaggttaccgccgttaaccacggtatcgatatgcgaaccgctcagaaccacttcttgtggatattcggtgccactcaggcgaccatataaattccccacttcatcgaaacgtgtttccagcccgcttgctgccattctttttttaaattgctgctgagtttccagccattccggcgaataaagtaaacgggtcatcccacccgttgggtcagcgccaaaagaggaaagccagggcagcgtttcttctatggcttgacggaaatgtgtaatcataagaaagtcctgtctcaataattattgcgcaaagggatttttcgtttcgtatgacgtgttataaagcgcgtcagaaattaaatactggtaaatatcatcaacaatttcgatgccttcgacggcggctttgcgttgtttaatatcctgatcctgtccgggataataaacctggttaaaaccgggcgcgggggttatggcatttaattcgcgcatggtctggctaagatgttgacggaatagttcgctggaggagaaaaagttcgggttaataacgatatgtaattgccccaaattacgcccggcgtgtaaatcgtcatacatcgaactaacctgtcgcccgaacggtaagccgagtaagacgcctgagaggacgtcaatcatcatcatcaggccataccctttcggtccggcggcagggagcagggcgttaactgcaaatggatcggttgttggtgctccgtttttatcgaccgcccaggtatccgggatagacatattacgcgagcgggcgtcgagcacttttccccatgcctgtacggtagtcgccatatcaaaggtaaggatctcgtcgccttctcccggcgcggcaaaggccagtgggttagtaccgtagtaaatttccgcgccgccaaacggcaccaccattggatcggactggcacatcgaaatgccaattaatcctgcgcgggctgcctgctgcacaaaataagagattgcgccgctgtgacccatccggctgataccgaccaccgcaacgccattttgctgggcggttttgatggcatgttccatacccattttcgccgcgacctgtccggcagcattgtcggcatgtaaaattgccgaacacggcccggtttcttcaagacgaaattccggttcacggttggtgccgccttttgaaatgcgttccgcgtagtattccacgcgcaccgcgccatgagagtggatccctctggcatcggcgtaaaccaatacttcagccacggttgcagcgtgctcacgttttaacccagcctggcagagtttattctcgattagctggcggagtgtttcccgactgattttcatctgtcttcctttttaacgacggtgtgaagcatgactgcaattaacatacagggaaaatatctggattatgtgatccagacaggcaaaaaaatatagttagaatttatttgataatccgctcgcttttaacctggtttttaaaacaaccacgcttattaaaaaataacacgtaatagcatggcggttatttgaattcttttgttaataatccctgtgtgatattcatcaccttattttcccgttctcatcgataccgtaatcgccacattaacactgctcgtgcaattgccatgggtgcaatttttaaggagttgttatgatccacgcctttattaaaaaagggtgttttcaggattctgtcagtttaatgattatttcacgaaaactcagcgaatcagaaaatgttgatgatgtttccgtaatgatgggtacgcccgccaataaagcgttattagataccacaggtttctggcatgacgattttaataacgccacgccgaacgatatttgcgtggcaattcgtagcgaagcggcggatgcggggatcgcgcaggcgattatgcaacagcttgaagaggcgctaaaacaactggcgcagggttcaggcagcagccaggcgttgacgcaggtgcgtcgctgggacagtgcctgtcagaaattacccgatgccagtctggcgctgatttcagtggctggcgagtatgcggcggagctggctaatcaggcgctggatcgcaacctcaacgtgatgatgttctccgataacgtcacgctggaagatgaaatccagctcaaaacccgcgcacgcgataaaggcttgctggtgatggggccggactgcggtacgtcgatgattgccgccacgccgctggcttttgctaacgtgatgccggaaggcaatattggcgtcattggcgcttccggtaccgggattcaggagctgtgttcgcagattgcgctggcaggtgagggaattacccacgcgattggtcttggcgggcgcgacctcagccgtgaagtgggcggcatcagtgcgctaacggcgctggaaatgttaagcgccgacgcgaaaagcgaagtgctggcatttgtttcaaaaccacctgccgaagctgtgcgtctgaaaattgttaatgccatgaaagcaaccggcaaaccgacggtggcgctgtttttaggttataccccggcggtggcccgcgacgagaatgtctggtttgcctcctcgcttgatgaggccgcacgcctggcttgcctgctttcacgcgtcacggcgcgacgtaacgcaatagcacctgtcagcagcggatttatttgcggtttgtataccggcggtacgctggctgctgaagcggcgggattacttgccggacaccttggcgtggaagccgacgatacccatcaacatggcatgatgctcgacgccgacggacatcagatcctcgacctgggcgatgatttttacaccgtcgggcgtccccatccgatgatcgacccgaccttacgcaacctgttaattgccgatctcggcgctaaaccgcaagtgcgcgtgttgctgcttgatgtcgtgattggcttcggtgcgactgccgatcctgccgcctcgctggtgagcgcctggcaaaaagcctgtgccgcgcgtccagacaatcaaccactgtatgccattgccacggtgacaggcaccgaacgtgacccgcaatgccgctcgcaacaaatcgccacgctggaagatgcggggatcgcggtcgtgagttcgctgccggaagccaccttgctggcggcagcgttaattcatccgctctcgcctgccacacagcaacacacaccgtcattactggaaaacgtcgccgtgattaacatcggattacgcagctttgcgctggcgctacaaagcgccagcaaaccggttgtgcattaccaatggtcgccagtcgccggcggcaataaaaaactggctcgtttattagaacgtttgcaataaggggttcccatgtttacatcagtggcgcaagccaatgctgcggttatcgaacaaattcgtcgtgctcgtccacactggctggatgtgcaaccggcttcttcacttatcagcgaactaaacgagggcaaaacactgcttcacgccgggccgccaatgtgctggcaggagatgaccggacccatgaaaggggcatgtgtgggcgcatgtctgtttgaaggctgggcgaaagatgaagcgcaggcgctggcaatgctggatcagggggaagtgaacttcattccttgtcaccatgtgaatgccgtcgggccaatgggcggcattacttctgccagtatgccgatgctggtggtcgagaacgtgaccgacggcaaccgggcgtactgcaacctcaacgaaggtatcggcaaagtgatgcgttttggcgcttacggcgaagatgtcctgactcgccatcgctggatgcgcgatgtgttaatgccagtattaagcgcggcgctggggcgcatggagcgcggtatcgatctcaccgcgatgatggcgcagggcattaccatgggcgatgagttccatcaacgcaatattgcttcctcagcactgttaatgcgtacgctggccccacaaattgctcgcctcgatcatgataaacagcacattgcggaagtgatggatttcctcagcgtgaccgatcagttcttcctcaacctcgcgatggcctactgcaaggcggcgatggatgctggcgcgatgatccgctcaggcagcatcgtcacggctatgacccgcaacggcaatatgttcgggattcgggtcagcgggctgggcgaacgctggtttactgcgcctgtaaacactccccaaggtctgtttttcaccggtttctcgcaggagcaggcgaacccggatatgggcgatagcgcaattaccgaaacctttggtattggcggagcggcgatgatcgcagcgcctggcgtaacgcgctttgtcggtgcgggtggcatggaagcggccagagcggtatctgaagagatggcggaaatcttccttgaacgcaatatgcagttgcagatccccggctgggattttcagggcgcgtgcctggggctggatattcgtcgcgtggtagaaaccggcattacgccactcatcaataccggtatcgcccataaagaggcggggatcgggcagattggcgcaggcactgtgcgggcaccgctggcgtgctttgaacaggcgctggaagcactggctgaaagcatggggattggttgaggaacgcacaatgacgatcatccatcctctgcttgccagccgtagtgcaccgaattatcgccagtcctggcggttagcgggcgtgtggcggcgggcgattaacctgatgacggaaagcggtgaattgttaacactgcatcgtcagggtagtggtttcggccccggaggatgggtgcttcgccgcgcgcaattcgatgcgttatgcggtggattatgcggcaatgaacaaccgcaggttgtggcacaagggattcgcctcggacgtttcacggttaaacagccacagcgttattgtttgctgcgtattacgccgcctgcgcatcctcaaccgcttgcagctgcatggatgcaacgcgcggaggaaaccgggcttttcgggccactggcgttggcggcaggcgatccgcttcctgctgaattacgccagtttcgccactgttttcaggccgcgctcaatggcgtgaagaccgactggcggcactggctgggcaaaggtccgggattaacgccgagtcatgatgacacgctgagcggaatgctgctggcggcctggtattatggcgctttagatacgcgctccggtcgccagttttttgcctgttccgacaatcttcaactcgttaccacagcggtgagcgtcagttatttacgttatgccgcgcaaggatatttcgcctcgccactcctgcactttgtccatgctctgagttgcccgaaacgtaccgctgttgcgattgattcgctgctggcgctggggcatacgtcaggggcagatacgctgctggggttctggcttggtcaacaattattacaaggaaaaccatgaaaacactggttgtggctcttgggggcaacgccttactccagcgcggtgaggcgctgacggcggaaaatcaatatcgcaatatcgccagtgctgtacccgcgctggcacgcctggcccgttcttatcggctggcgattgttcacggcaacgggccgcaggtggggctgctggcattgcagaatctggcgtggaaagaagtggaaccgtatccgctggatgtgctggtggcggaaagccaggggatgattggctatatgctggcgcagagcttgagcgcacagccgcagatgccgcctgtcacgacggtgctgacgcgcattgaagtttcgcctgatgatccggcatttttacagccagagaagtttatcggtccggtttatcagccagaagaacaaaaggcactggaagcggcttacggctggcagatgaaacgtgatggtaaatacttgcgccgggtggtggcgtctccgcaaccgcgtaaaattctcgacagcgaagccatcgagttgttgctcaaagaggggcatgtggtgatttgcagtggtggtggcggtgtgcctgtgacggacgacggagcagggagcgaagcagtgattgataaagatctcgccgctgcgttgctcgccgagcagattaacgccgatgggctggtgatcctcaccgatgctgacgcggtttatgaaaactggggaacgccgcagcaacgcgccattcgccgtgccacaccggatgagttagcgccatttgccaaagccgatggttcgatggggccgaaggtaacggcggtgagtggctatgtcagaagccgtggcaaacctgcgtggattggggcgttatcgcggattgaagagacgctggcgggcgaagcggggacctgtatttcgctgtagtcgtaggcattagacatttgtgcctgatgcgacgcttgacgcgtcttatcaggcctacaatgggtaccggagcgttaagccggataaggcgttcacgccgaatccggtaagaatatgtgcaccaggttaactgaacttactctgcgcccaaatcacgccgctggcatactctggcggcagcagcgggattaaggcttccagcgtcgcggtcagacgcgatgtgtcgctgtcggtcaaattcagatgccccactttacggcccggacggacttctttgtcgtaccagtgcagatgcaccagcggcaatttcagccagtcataattcacatcgctaccaatcaggttgatcatcaccgacggactattcactaccggttgcggtaacggcagatcggtaatcgcccgcagatgcagctcaaactggctgatgctggcaccgttttgtgtccagtgaccgctgttatgcacacgcggagccagttcgttgatcagcagaccttgcggggtgacaaaacactccatcgccatcacgcccacatagcccagctcctgcataatcgccgacagcatctcttcggcttgcgcttgctgctgcgcattggcctgcgggaaagcgacgctggtacgcaaaataccgtcctgatgcaggttatgcgtcagcggataaaacacggtgctaccatcaaagccgcgcgcgccaaccagcgacacttcgccagagaagttaatgccctgctcgacaatacattcgccgtaacactctgccggtaactgttcggtttcatcggcacgtaaacgccattgaccgcgaccgtcatagccaccagtgcgacgcttaacaatcgccagctcacctaaacgatcaaacaccgcaggccactcgctgcgatcggcaagtaactgccacggtgcggtcggcaggtggagcttatcgaaaagctgtttctgagtcagacggtcggcaataatcgggaacacatcgcggttcacaaaggccggatggcgcgccagttcgcgggttaatgcggtttccggccagcgttcgatctcagcggtaatcacgctttgttgaaaaggcaccgccgccggttcagcgtccagtccgaccggccagacagcaatgcctaacggttcgcctgcctgacgcagcatacggcctaactgcccgttaccgaggacgcaaacctgtttcatgccgcacctcgcgggtccgggttttccagcacttcatcagtttgtgctttgcgccagtcattcagacgctggtgcagttctttatcatgagtcgcaagaatttgtgctgccagtaatgccgcgtttgccgcgccagctttaccaatcgccagcgtacccaccggaatgccgcgtggcatttgtacgatggagtagaggctatcgacaccgctcagtgcggcgctctgtactggcacgcccagcaccggcaccagcgttttggcggcaatcatacctggcaggtgcgctgcgccgcctgcgcccgcaataatcacctgataaccgttctcttcggcgctttcggcgaagctgaacagtttatcgggggtgcggtgagcagaaaccacttcaacgtggtgcgggacattcaggatttcgaagatttcggcggcgaactgcatggtagcccagtcgcttttggaccccatcacgatggcgacacgcgccggattattgcgggaagacatgcgtcttaaaactcctgtggtgcacaactctcggctttagagggcacagagaatagcacggaaagagagcaaggaaaacggttgcgtggctgtgaaatcagcaaagttgcgggttttttaaaacggaaaatgaatcagctcaacgtcatccgccgtgactttcaccattgaaccttcagtatgccaggctcccagcacgacgcggaaagcaggttgctgattggcgataagttcatgtactgccgggcgatgggtatgcccgtgaatcagccattgcacctgatgtttttccatcgcactgactaccgcgttttggttaacgtccatgatcgccagcgatttactgctgttggcttctttgctgttcgctcgcattcgcgcggcaatgcgtttgcgcacaaacaacggcagggcgaggaatagcgtttgcagccagggtttgtggactttggcgcgaaaagcctgataaccggcgtcatcggtgcacagcgtgtcgccatgcataatcaatacccggcgaccatacagttcgagcaccttttcttccggcaataacgtcatgccgctttcacgggcaaagcgtttgccgagcagaaaatcacggttgccatgaatgaaataacagggaacaccggaatcggacaccgctttgatcgctgccgccatctggcgatggagtgggttgggatcgtcgtcgccaatccacgcttcaaacagatcgccaagaatatacagcgcgtcggccttgcgggcttcccccgctaaaaaacgcagaaaaccggcggtgatcgccggttcttccgcgcagagatgaagatctgcaataaagagtgtcgccacgattactcgctaacggtcacgctttcaatgataacgtcttcttttggcacgtcctggtgcataccgctacgaccggttgcaacacctttgattttgtctaccacgtccatgccttcaaccacttcagcaaacacgcagtagccccaaccttgcaggctttcgccagagaagttcaggaagtcgttatcaaccacgttgatgaagaactgtgcagttgcagagtgcggtgcctgagtacgggccattgccagcgtaccacgggtatttttcagaccgttgttggcttcgtttttgatcggttctttggtggctttttgtttcatacccggttcaaaaccgccgccctgaatcataaagccgttgataacacggtggaaaatggtgttgttgtaaaaaccttcgcggcagtagtccaggaagtttttaactgtttcaggtgctttatcgtcaaaagttttgatgacaatatcgccgtgattggtgtggaaagtaaccatttttgcatcctgttccgtttgattggtgcttcaacccggttcgggtcatatatagggtggtgttatagcataaccgcacgatcggatcatcacgcaatgtatgctgattcgcgcgggaaatatgggtattatacgcaactcaattacccacacatgtctaaacggaatcttcgatgctaaaaatcttcaatactctgacacgccaaaaagaggaatttaagcctattcacgccggggaagtcggcatgtacgtgtgtggaatcaccgtttacgatctctgtcatatcggtcacgggcgtacctttgttgcctttgacgtggttgcgcgctatctgcgtttcctcggctataagctgaagtatgtgcgcaacattactgatatcgacgacaaaatcatcaaacgcgccaatgaaaatggcgaaagctttgtggcgctggtggatcgcatgatcgccgaaatgcacaaagattttgatgctttgaacattctgcgcccggatatggagccgcgcgcgacgcaccatatcgcagaaattattgaactcactgaacaactgatcgccaaaggtcacgcttatgtggcggacaacggcgacgtgatgtttgacgtaccgaccgatccgacatatggcgtgctgtcgcgtcaggatctcgaccagctgcaggcaggcgcgcgcgttgacgtggtcgacgacaaacgcaacccgatggatttcgttctgtggaagatgtcgaaagagggcgaaccgagctggccgtcgccgtggggcccgggccgtccaggctggcacattgaatgttcggcaatgaactgcaagcagctggggaaccactttgatatccacggcggcggttctgacctgatgttcccacaccacgaaaacgaaatcgctcagtccacctgtgcgcatgatggtcagtatgtgaactactggatgcactccgggatggtaatggttgaccgcgagaagatgtccaaatcgctgggtaacttcttcaccgtgcgcgatgtgctgaaatactacgatgccgaaaccgtgcgttacttcctgatgtcgggccactatcgcagccagctgaactacagcgaagagaacctgaagcaggcgcgtgcggcgctggagcgtctctacactgcgctgcgcggcaccgataaaaccgttgcgcctgcgggtggcgaagcgtttgaagcgcgctttattgaagcgatggacgacgatttcaacaccccggaagcctattccgtgctgtttgatatggcgcgtgaagtaaaccgtctgaaagcagaagatatggcagcggcaaacgcgatggcgtctcatctgcgtaaactttcctccgtattgggcctgctggagcaagaaccggaagcgttcctgcaaagcggcgcgcaggcagacgacagcgaagtggctgagattgaagcgttaattcaacagcgtctggatgcccgtaaagcgaaagactgggcggcggcagatgcggcgcgtgaccgtcttaacgagatggggatcgtgctggaagatggcccgcaagggaccacctggcgtcgtaagtaattgcgctattgccggatgcgagttttcgcatccggttatcgtctgcgccaccacaacattcccatcagtagcatccccggcaaccacacccacatcaattcagaaataatcacctgatgcccgtacggtgtgctgtaacgagacaatgcaaacggcgcgactttaatcacctgccagggagcgaaaaagcgttcatctgaccacggccacagccagccaacccctttaccgccagtggttaccgaatccagcaagctgtgcgatagcaacgagacggttaaaaacagccagcagcgaatcagcccagccctgaaccatcggcgtccaatcagcacacataacagcgggacaacaaacgcaaacaccagcgaatgggtaaacccgcgatgaccaaaaacattgccgtaagcaacgccaaatttaaacgacaagacgtcggcatcgggcagcatcgccaggatgattccggcaaataacaggcgcggagggatgactttcgaacccaaccctaaaccaatgcaaaggggaacggcggcgtgcgtaataacggttggcatgatggtcccttcggcaaaatgtcgatgctatcagcatggatgaacggggcgtagagggcaaaagtctgaaaagagaaccggcctgttgatacaggccggggaagggatcaggcaacaacctgtacgctgtgaccggcaaaactcactgtctgaccggcgacgattttgcagcgtttgcgcgtttcaaccgcaccgtcgacttttacctggccttcggcaatcgcgattttcgcctgcgcgccgctttcgctccagccttccagtttcagcaagtcgcacagctcaacgtgcggatgtttacctaaagaaaatgtcgccatgttactcaccctgtggatcatgatattcaacgcacgcctgtagcgtgttttcaatcagcgtggcaaccgtcatcgggccaacgccgccgggaacaggcgtaatgtatgaggcgcgtttagccgcgtcttcaaacacgacgtcgcccacaactttgccattttccagacggttgatgccgacatcaatcacaattgcgccttctttgatccagtcaccgggaataaagcctggcttaccgacggcaacgatcaatagatcggcattttctacgtggtgacgcagatttttagtgaaacggtgagtcacggtggtggtgcaacctgccagtagcagttccatgctcatcgggcggccaacgatattcgatgcgccaatcaccacggcgttgaggccgaaggtatcaatgttgtaacgctcaagcagcgtgacaataccgcgcggggtgcagggacgcagacgcggcgcgcgctggcacaggcgaccgacgttataaggatggaaaccgtctacgtctttgtccgggtgaattcgttccagcactttgacgttatcaatacccgccggtaacggcagttgaaccagaatgccatcgatggtgttgtcggcattcagcgtatcgataagctccagcagctccgcttcgctggtggtttccgggaggtcgtaagagcgggagacgaacccgacttcttcacaagccttgcgtttgcttgcgacataaatttgcgatgcagggttactacccaccagcacaacggccagtcctggtgcccgcagtccggctgcaatacgcgcctgaactttttgagcaacttcagagcgcacctgctgcgcaatcgttttaccgtcaataatctttgctgccatcagagagaggattccatctgttacgtaggtcgaaggggatgcgcctattttgtcagaagcggggcgcgctgtcaggtttcgtttcagatttatcgcgtgaagcgacctcgtgcgaaggtgaggcgcactgtcgctgagattgaaagcttcatttttcgtccatgatggcgttgtaaatctggaactgacttatttccttgtcaaaggattaagataatttaagaaatacctgacaatataaaaagaattttcggcctggtaatttaccgcttcaggtctatatttgtgttgaatatattttgcgcggaagtattcatctaacggggctctctattttttagaatagagtgcatattttcaattaagacattcttagaggataaaaaggaatttactactatcagtgtcttaaataaagtaatcggttatatacggatgtggagtcgataaatgagattgaaggaatatatatgaaattaagatttatttcgtctgcgctggccgccgcactattcgccgctacgggtagttatgctgccgttgtagatggcggtacaattcactttgaaggcgaactggtgaatgctgcctgttcagtgaatactgactcggcagaccaggttgtcacactcggtcaatatcgtaccgatattttcaatgctgttggtaatacctctgcattaattccattcactatacagttgaacgactgcgatcctgtcgttgccgctaatgctgccgttgcattttctggtcaggcggatgcaatcaatgataatttattggccattgcatccagtactaatacaacaacagcaacgggtgtcggtattgaaatacttgataatacatccgcaattctcaaacctgatgggaatagcttctcaaccaaccagaacttgatccccgggaccaacgttcttcatttttctgcacgttataaaggcaccggtacaagtgcatcagcagggcaagcaaatgctgacgcgacttttattatgagatacgaataatcaaaaccacgttgttttgaattatatatcacgtcttataacaaagtaatgtaccggttgtctgaagcggtatggtggcaatgtaaatcgaaatcatattcactttgtatcatgccgctttattaaatgaaaagggaatgatgtgttgtaagaaaccaaagcaatcatttctttatatttcttatttttgccgtcaggaatacacaaggcgtattaactatgatgactaaaataaagttattgatgctcattatattttatttaatcatttcggccagcgctcatgctgccggagggatcgcattaggtgccacgcgtattatttatcccgctgatgctaaacagactgcggtatggattagaaatagccataccaatgagcgctttctggtcaattcatggattgaaaacagcagcggtgtaaaagaaaagtcattcatcattacaccgccactgtttgttagtgaacccaaaagcgaaaatactttgcgtattatttacaccggtccaccgctggcggcagatcgtgagtctctgttctggatgaatgttaagacgatcccttcggtagataaaaatgcattgaacggcaggaatgttttgcaactggcgattttatcgcgcatgaaattatttctccgtccaattcaattacaagaattacccgcagaagcgccgtacacactcaagttttcgcgatccggtaactatatcaatgttcataatccatcacctttttatgtcaccctggttaacttgcaagtgggcagccaaaaactggggaatgctatggctgcacccagagttaattcacaaattcccttaccctcaggagtgcagggaaagctgaaatttcagaccgttaatgattatggttcagtaaccccggtcagagaagtgaacttaaactaaccgaatcatctgacaatatcagagctaattatgaaaatacccactactacggatattccgcagaggtatacctggtgtctggccggaatttgttattcatctcttgccattttaccctcctttttaagctatgcggaaagttatttcaacccggcatttttattagagaatggcacatccgttgctgatttatcgcgctttgagagaggtaatcatcaacctgcgggcgtgtatcgggtggatctctggcgtaatgatgagttcattggttcacaggatatcgtatttgaatcgacgacagtaaatacaggtgataaatcaggtgggttaatgccttgttttaatcaggcactccttgaacgaattggccttaatagcagtgcattccccgagttagcccagcagcaaaataataaatgcattaatttactgaaagctgtacctgatgccacaattaactttgattttgcagcgatgcgcctgaacatcactattcctcagatagcgttgttgagtagcgctcacggttacattccgcctgaagagtgggatgaaggtattcctgctttactcctgaattataatttcaccggtaacagaggtaatggtaacgatagctatttttttagtgagctcagcgggattaatattggcccgtggcgtttacgcaacaatggttcctggaactattttcgcggaaatggatatcattcagaacagtggaataatattggcacctgggtacagcgcgccattattccgctgaaaagtgaactggtaatgggagacggcaatacaggaagtgatattttcgatggcgttggatttcgtggtgtacggctttattcttccgataatatgtatcctgatagccagcaagggtttgccccaacggtacgtgggattgcccgtacggcggcccagctaacgattcggcaaaatggttttattatctatcaaagctatgtttcccccggcgcttttgaaattacagatttgcacccgacatcttcaaatggcgatctggatgtcaccatcgacgagcgcgatggcaatcagcagaattatacaattccgtattcaacagtgccgattttacaacgcgaagggcgtttcaaatttgacctgacggcgggcgattttcgtagcggtaatagtcagcaatcatcgcctttcttttttcagggtacggcactcggcggtttaccacaggaatttactgcctacggcgggacgcaattatctgcaaattacaccgcctttttgttagggttggggcgcaacctcgggaactggggcgcagtgtcgctggatgtaacgcatgcgcgcagtcagttagccgacgacagtcgtcatgagggggattccattcgcttcctctatgcgaaatcaatgaacactttcggcaccaattttcagttaatgggttaccgctattcgacacaaggtttttatacccttgatgatgttgcgtatcgtcgaatggaggggtacgaatatgattacgattatgacggtgagcatcgcgatgaaccgataatcgtgaattaccacaatttacgctttagccgtaaagaccgtttgcagttaaatatttcacaatcacttaatgactttggctcgctttatatttctggtacccatcaaaaatactggaatacttcggattcagatacgtggtatcaggtggggtataccagcagctgggttggcatcagttattcgctctcattttcggtaatgactccaacttactgatagtgttttatgttcagataatgcccgatgaccttgtcatgcagctccaccgattttgagaacgacagtgacttccgtcccagccttgccagatgttgtctcagattcaggttatgccgctcaattcgctgagtgtaacgcttgctgattacgtgcagctttcccttcaggcgggattcatacagcggccagccaggcaaaatacgtttcagttatctggcaaaaactgatcccgagtcaggctgattcttaatgttcaactgtcgccggttgtgactggtattctgcaaccggcgctcgtctaatataagagataaagaaatcgatgagcgaagtaatcatgattgtctctcccggcaaatgggtatccgaagagcagttaattgcgctgaaaggaataaaaaaaggtacgttaaaaaaggcccgggaaaaatcgtttatggaaggaagggaatataagcatgtcgctcatgacggtatgccatgggataacagtccatgcttttacaacctggaagaaattgatcgctggattgagcgccaggcatcagcaagaccaagacgtcatcttacttgactaaaagccacactaactaatgagagaagttgaaatgaaatatccgacaggcgtggaaaaccatggagggaaattacgtatctggtttgtttataaaggcgtaagagtcagggaaaacctgggggttcctgacacagcaaaaaacaggcgcgttgcaggtgagctacgcgcctctgtttgttacgcaataaaaactggtgttttcgactatgcaaaacagtttccctcctcacgcaatctggaaaaatttggtgaggcccgacaagatttaaccataaaagaactggctgaaaaatttctggcactgaaagaaactgaagtcgcaaaaacatcactcaacacataccgtgccgtcatcaaaaatatcctgagcataatcggtgaaaaaaatcttgcctcatcgattaataaagaaaaattactggaggttcgtaaagagctactgactggataccagatccccaaaagtaactatattgttacacaaccagggagatcggctgtaactgtaaataattacatgacaaatcttaacgccgtgttccagtttggtgttgataacggttacctggtagataacccgtttaaggggatctcgccattaaaggaatcaagaaccattccggatcctctttcgcgggaggaattcatccgtcttatcgatgcgtgcagaaatcagcaagccaaaaatttatggtgtgtttctgtttatactggcgttcgccctggtgagctgtgtgcacttggatgggaggacatagatctgaaaaatggaacaatgatgatcaggagaaatttagcaaaagaccgtttcacggtaccaaaaacacaggcgggaaccaatcgggtcattcatcttattaagccagcaatcgacgctctccggagtcagatgacattaacgagactgagcaaagagcatatcattgatgttcacctcagagagtatggcagaacagaaaaacaaaaatgcacctttgtttttcaacctgaagtgtcagcgagagtaaaaaattatggtgaccattttaccgttgactcaataaggcagatgtgggacgcagcgataaaacgtgccggactccgccatcgaaaatcatatcagtcgagacatacttatgcctgctggtcgctgacagctggtgctaacccggcatttatagcaaaccagatgggccatgcagatgcgcaaatggtatttcaggtatacggaaaatggatgtctgaaaacaataatgcacaggtagctttgttaaatacacagttaagcgagtttgccccaaccatgccccataacgaagcaatgaaaaattaatttaatatttatcaaatagttaacactcatgactcttgaaatccataaattcaagcgcagtgcccagccatcccgatactgctgctttcaccaaatccttagtgcttctttcgtgtttttctattgtcataatggttatctctaaaaaagaggtaagatgcgtactacttactcgccgttattggtattattcagaaaaagtgagtaagactttgcagcaatgcttttgatcctgttcaaataaactaatggcatcagcaacatgctggaaatcaaacgtatgggtaattagtttttctggtttaattaaccctttacttaaccagtcgataacgaccgggaatttatttgcatttaagcgtgaagagaaaatagagagttcttttccggtaattccttgctgaatcacttcagacggttcactggagaagcccatcaatacaatacgtgccgctggagaagccagcgttacggcttctttcaggattgaaggatgacaagccgcatcgataattaatgtcggctttatgcctttttcagcgaaaatctcgccaagcggtgtctggctgttattaatcgcccagtctgccccgctctctttcgctttttccagtcgttcatcaatgcgatcggcaacaatcacattcttaacgttatagacgccttttaatacctgaacgatcgtcaggccgattggaccggcaccgtaaaccagaacggtatcattttcagtcggttgaccatgaccggtaacgttagccgcaatggtaaaaggttcgatcatcaccgcatattgatcggccactgcttcaggaattttccacgcattttttgccggcaccacggcatattcactgaaaccaccgtcagcgtgcacacctaatacagccagtgtcgtacaaacgttcggcttacctatagagcacggatagcaatgcccacagctgaccaccggatcgacagcaacgcgttcaccgactctggcgctttccacgccttcacccactgcatcaatgacgccaaagaattcatgaccaatgacgcgcggatatttcgcaaaaggattatgcccacgataaatatggctatctgaaccacaaattccggcaagtttcacttttactcgtacttcacccgctgacggggtgggtatttcgcgttcgataattgccagttgattcggtttttcaattaaaatgcttttcattatcttactccttaccagttccacagcgtgccatcttccagacgtgcgactggcagataagcaggttcatagggatatttcgccgccagcttttcatcgaattcgatgccaagacccggtttgtctcccggatgcatatagccgttatcgaaagtccagttgtgcgggaagacttcaagcatttgttcggaataacccatgtattcctggacaccgaaattggggacccacagatcaaagtgcagcgccgcagccatgcagactggtgacaaatcggaaggaccgtgtgagccagtacgtacctgatacaacgaagcaaaatcggcaatccggcgcataccggtaattccgcctgcatgggtcagcgtggtgcggatataatcgataagttgctcttcaatcagttgcttgcagtcccagatgctgttgaagacttcacccaccgcgatgggtgtgacggtatgttggcgaatgagacggaagcattcctggttttccgcaggcgtcgggtcttccatccagaacatgcgataatcttcaatgcttttaccaaagcgcgccgcttcaataggcgttaagcgatggtgcatgtcatgcagcaaatgttcattaaaaccaaacttgttacgtaccgcgtcaaacaatttcggcatgaaatcgaggtatttctccgtcgaccacaactgctcttccggccactgtcctttggttgcgggttcataagccagacctttgcctttcgacatgccgtaggtggttttcataccagggattccgcactgcacgcggatggctttgaatcccagctcctgatgacgggcataatcatccagagcttcatcaatactgtgaccggtggtatggcaataaaccatcaccccttcacgagacgcgccgccgagtaactggtaaagcggcatgttggcagctttggctttaatatcccacagcgccatatcaaccgctgaaatggccgacatcgtcaccggaccgcgacgccagtaagcacctttatagaaaaactgccagatatcttcgatacggtgtgcatcgcgaccaataagctgcggacaaaggtgatcctgcaaataagaggccacggaaagctcacgtccattgagggtggcatccccaaggcccgtaataccgtcctcagtggtgatttttaatgtgacgaaattacgccccggacaggtaacaaaaacttcagcctttacgatcttcatgttcgattccttgcatcgcttgtcgtgatgcatgaaatctacgcaactgagctactaccatacaagtatgaagatcgaaaaaagccggagtgatcacaaaaaaaggcgtatatttgcgccgtgaatggttgacaaaagatgaaatagaataccttttgtcagctgacacttccttgtatcttattgataaaatggatttatgtccttacgcgcgcccccagcccgcaacaatgatcaacatgccgcaaagcgcaatcaacgcccccgtccagtcataaagactcagtttcacgccatccacaacgcgcagccacatcaacgccgtgcagacataaacgccaccataagccgcgtaaacacgcccactcgccgcaggatgcaacgttaacaaccagacaaacagtgccagagaaatccccgccggaagcaacagccagatactggcgtttcgttttaaccacaaccagggcagaaagcatccaataatttcacacagcgcagtagcaaaaaatagtaacgttgttttaatcatctttgtcacttattgacatcatgtatagttataggacgacataatatcatcaatataaacatcctcctggtacgttttgcgttcgcagtggatggtgtagaatcacctttaatcattcatacagggaatgaattatgaaaattactctcagcaaacgaattggcctgctcgcttttctgctgccttgcgcactggcattgagcacaactgttcatgccgaaactaacaaactggtgattgagtctggcgacagtgcgcaaagccgccagcacgccgctatggaaaaagagcaatggaatgacacgcgcaatctgcgccagaaagtgaataaacgcactgaaaaagagtgggataaagccgacgccgcttttgataaccgcgataaatgtgagcaaagcgccaacatcaatgcctactgggagccaaatactttgcgctgcctggaccgtcgaactggccgcgttattaccccctaacctgttattgatttaaggaatgtaaggacacgttatgccaagcgcccacagtgttaagctacgcccgctggagcgtgaagatttacgctatgtacatcaactcgacaataacgccagtgtgatgcgttactggtttgaggaaccctacgaagcctttgttgaactctctgatctgtacgataagcatattcacgatcagagcgaacggcgctttgtggtggaatgtgacggcgaaaaagccggtctggtggagctggtggaaattaaccatgttcatcgccgcgcagaatttcagataattatctccccggaatatcaggggaaaggtctggcaacgcgtgccgcaaaattagcaatggactatggcttcaccgttctcaatctctataagctgtatctgatcgtcgataaagagaatgaaaaagcgatacacatttaccgcaagcttggctttacggttgaaggtgaattgatgcatgagttctttattaatggtcaatatcggaatgccattcgcatgtgcatattccagcatcagtatctggcagagcacaaaacaccgggtcagactctcctgaagccgaccgcacaatagcattaataataatcgatagtatttttgatggtgtaaacccgttcgatggcgggttttactccttcatcaacaatgattagctgacagtccaccggattggcgtgactgtcatattcacagctctgttttacattaccaactctttgattattcagtatagtaaccgctgtgtaatctaattttttgatcgggtccgttgatggcgtggcgctaacagataatgttttgtcgtgacttttcgtggttttacccagcggatacccctgatcatcatagcgatattccatctgcatctgtttgctgctggctttaatcacaaagccattatcatcggtttcccaactcaccccggcagaaggtaattctgctagctggcattttccctgcaaacgaactcttttctccagtgtctgggcatcacggtaataattggcgtccagtaccagggcaaccacggtattattttccagatccagtaattcgagtgaatcaaaacagccttcttccgacaaagtccccgaaacacgtttcgtcacttcaccttgctcatccattaatgtctgagtgaaatcttttaccggaccacgcagcggatcaaaatcgaattcattagagaaactggccatctcaggggtaaatgaaagtgttacctctgttcggtcacatcctgtgaggaatatcgcgagtaagcatggcagtaatttgtatttcacaacagtcaccagagagtagagatgattctcaatcatagtagcaaatacagtactttacaagttaaatgctatgcttaaagaagttatcttcgcgtaaggagcttatgatgaaactctcaacctgctgtgccgcgcttctgctcgccctcgcctcacccgcggtactcgccgcgccgggatcctgtgagcgcatacagagcgatatatcacagcgcattatcaataatggcgtacccgaaagcagcttcacgttaagtattgtacccaatgaccaggttgatcagcctgattcccaggtcgtcgggcattgcgctaatgatacgcataaaattctctacacccgcaccaccagcggtaacgtctctgctcccgcgcagtctacccaggatggcgcgcctgccgaaccgcagtaacacattatcgactgaacgccggatacgacacatccggcgatttgaacatacaacataatcccaccttattactcatacccttctattgatatggattaataattcttaacccaaaatgggtagactccctctattgttagcgcgctaaatattcaatatataaacttttatataacgataaagatcagggagtgagttatgtccaaaaatgaacaaatggtgggcatcagccgcagaacactcgttaaatctaccgcgataggttctctggcgctggctgcaggcggtttttctttaccgttcaccctgcgcagtgcagcggcagcggtacagcaggccagcgagaaagtggtctggggtgcctgttccgtcaactgtggtagccgctgtgcacttcgtctgcatgttaaagataatgaagtgacctgggtggaaactgacaacaccggcaacgacgagtatggcaatcatcaagtacgtgcctgtttgcgcggtcgctccatccgtcggcgtattaatcatcccgatcgcttgaattacccaatgaaacgcgtgggcaaacgcggcgaaggcaaattcgaacggattagctgggatgaagccctggatactatcgccagtagcctgaaaaaaaccgtcgaacaatatggcaatgaggctgtatatattcagtactcttcagggatcgttggcggcaatatgacccgctcttcgccatccgcctcggcggtcaaacgcctgatgaactgctacggcggttcactcaaccagtatggctcctacagcaccgcgcaaatttcctgtgccatgccctacacctacggcagtaatgatggcaacagcaccacggatattgaaaacagcaagctggtcgtgatgtttggtaacaacccggcagaaacccgcatgagcggcggtggcatcacttatcttcttgaaaaagcgcgcgagaaatcgaacgcaaaaatgattgttatcgatccgcgatataccgatacagctgctggtcgtgaagacgaatggctacctattcgcccgggcaccgatgccgcgctggttgcgggtattgcctgggtattgattaacgaaaatctcgttgatcaaccttttctcgataaatactgcgtcggctatgacgaaaaaaccttacccgcagatgcaccaaaaaatggtcactataaagcctatattcttggtgaaggagacgacaaaacagcgaaaacgccgcagtgggcttcgcaaattaccggtatcccggtggaccgtatcatcaaactggcgcgtgaaattggcacagcaaaacccgcttatatctgccagggctggggaccgcaacgccaggcaaacggcgagctgactgcacgcgctattgcgatgttgcctattctgacgggcaatgtcggcatcagcggcggaaatagtggcgcgcgtgaatcgacctataccattaccatagaacgcctaccggtgctggataatccggtcaaaacgtcaatctcctgcttcagctggacagatgctatcgatcatggcccgcaaatgacggcaatccgcgacggtgtccggggcaaagataaactggatgtgcccattaagttcatctggaactacgcgggaaataccctcgttaatcagcattctgacatcaacaaaacgcatgaaattctgcaggacgaatcgaaatgcgaaatgattgtggtcatcgaaaactttatgacctcatcggcaaaatatgccgacattctgctgccagacctgatgaccgttgagcaggaagatattattcctaacgactacgccggtaacatgggatatctcattttcctccagcctgtcaccagcgaaaaattcgaacgcaaaccgatttactggatcctgagtgaagtcgcgaaacgtcttggacctgaagtctatcaaaagttcactgaaggtcgcactcaggaacaatggttacaacatctgtacgccaaaatgcttgccaaagatccggcgttaccgtcttacgacgaattaaaaaaaatgggtatctataagcgtaaagatcccaatggtcattttgtcgcctacaaagcatttcgtgacgaccccgaggcaaatccacttaaaacgccttccggtaagattgaaatttactccagcaagctggcggaaattgcccgtacctgggaactggaaaaagatgaagtgataagcccactgccggtttatgcctcaacctttgaaggctgggactcccctgaacgtagtacctttccactgcaactgtttggtttccattacaaatcccgtactcactcgacctacggcaacattgatgtcctgaaggcagcctgccgtcaggaagtgtggatcaaccctatagatgcacagaaacgtgggattgccaacggcgatatggtgcgggtgtttaaccatcgtggcgaagttcggctaccagccaaagtgacaccacgcattctccctggggttagcgctatgggccagggagcctggcacgaggccaatatgtctggcgataaaatcgaccatggcggctgtgtgaatacgctaaccactctgcgcccttcaccactggcgaagggaaacccgcagcacactaatctggtcgagatcgaaaaaatataacccactacaaccataaattctgacatgacattttgtttgaaaagcaataagtgagtaatgatgaaaatccataccacagaggcgctcatgaaggctgaaatcagccgtagaagtctgatgaaaacctccgcacttggcagtctcgcgctggcaagcagtgctttcactctgccattttcccaaatggtccgagcggcagaggtaccggtagaagagaaagcggtctggagttcctgcaccgttaactgcgggagccgctgtctgttacgtttgcatgtgaaagatgacaccgtgtactgggtggagtctgatacgacaggtgacgacgtctacggtaatcatcaggttcgggcgtgtttacgcggacgctctatccgtcgacggatgaatcatcctgataggttgaaatatcccatgaagcgtgtcggcaagcgcggtgaaggtaaatttgaacggataagttgggacgaagccctggataccatcagtgataatcttcggcggatcctaaaagattacggcaatgaggctgtacatgttctctatggaacaggcgtagatggcggaaacatcaccaactcaaacgtcccgtaccgtctgatgaactcttgcggtggttttctcagtcgctatggcagctacagtaccgcacagatcagtgccgcaatgagttatatgttcggtgccaatgatggcaacagcccggatgatatcgccaatacgaaactggtcgttatgttcggaaataacccggcagaaactcggatgagcggcggtggtgtcacttactacgtcgagcaagcccgagaacgttcaaatgcacgcatgatcgtcatcgatccacgttataacgacacagctgccggacgtgaagatgaatggctgcccattcgccctggcaccgatggagcactggcctgtgcgattgcctgggtactgattactgaaaacatggtcgatcagccatttctcgacaaatattgtgttggttacgatgaaaaaacgctgcccgccaacgcaccacgtaacgcgcattataaagcctatattctgggcgaagggcctgacggcatagctaaaacgccggaatgggcagcaaaaatcaccagcataccggcagaaaaaattatccatttggcacgagagatcggttcagcaaaacctgcttatatttgtcagggttgggggccacaacgacactccaacggcgaacaaacgtcccgcgctattgccatgctttccgttctcaccggtaacgtcggcataaacggcggcaactcaggtgtacgcgaaggtagctgggatctgggggtagaatggttcccgatgcttgagaatcctgttaaaacgcagatttccgtctttacatggacagatgccatcgaccacggtacggaaatgaccgcgacccgtgatggtgttcgtggaaaagaaaaactggatgtccccatcaagtttttatggtgctacgccagtaacacattgatcaatcaacatggcgacatcaatcacacccatgaggtgcttcaggatgacagcaagtgcgagatgattgttggcattgaccacttcatgactgcctcggctaagtattgcgatatcctgttgcccgacctgatgccaacagagcaagaagaccttatctctcacgaatctgccgggaatatgggctatgtgatcctcgcccaacccgcaacctcagcaaaatttgaacgcaaacccatctactggatgctgagtgaagttgccaaacgcttaggaccagacgtttatcaaacctttactgaaggtcgcagtcagcatgaatggatcaaatatctccatgcgaaaacgaaggaacgtaaccctgagatgcccgactacgaggagatgaaaacgaccgggatctttaagaaaaaatgcccggaagaacactacgtcgctttccgcgcattccgtgaagatccacaggcaaacccgttgaaaacaccttcggggaaaatcgaaatttattctgaacgactggcgacgattgcggatacctgggaattgaaaaaagatgaaattattcatccccttcctgcgtataccccaggttttgatggctgggacgatcccctgcggaaaacctatccactgcagttaacgggcttccactacaaagcgcgtacccactccagctacggcaatattgatgtgttacagcaggcctgcccacaagaggtgtggatcaaccctattgatgctcaggcacgcggtatccgtcatggcgataccgtgcgggtatttaacaataatggagaaatgctgattgccgcaaaagtgactccgcgtattctgcctggcgttaccgccatcgggcaaggtgcgtggcttaaagcggatatgtttggtgaccgggtcgatcacggcggcagtatcaatattctgacctctcaccgcccttcaccgctggcaaagggaaacccgtcgcacagcaatcttgtccagatcgaaaaggtttaaggagtagcccatgaccacacaatatggattttttatcgattccagccgctgtactggctgtaaaacctgcgaactggcgtgcaaagattttaaagatcttggcccggaagtcagtttccgccgtatttatgaatatgctggcggcgactggcaggaagataatggcgtctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcgccacagtacaatgctgaaaaaggacacatgacgaagtgcgatggttgttattcgcgcgtcgccgaggggaaacaacccatatgtgtcgaatcctgcccgctgcgtgcacttgagttcggtccaattgaagagctgcgccagaagcacggcactctggctgccgtcgcgccactaccgcgcgcgcatttcacaaaacccaatatcgttatcaaacctaacgccaacagccgcccgaccggcgataccactggttatctggctaatccggaggaagtgtaaaatgggaaatggatggcatgaatggccactggttatctttaccgtattgggtcaatgcgtagtaggcgcgctgattgttagcggaattggctggttcgccgccaataatgacgcagaccgtcagcgtattgtccgtggcatgtttttcctctggctgttgatgggcatcgggtttattgcctctgtcatgcacctgggatcgccactgcgagcgtttaactcgctgaatcgaatcggagcttctggtctgagtaacgagattgctgccggttccatattttttgccgttggcggattatggtggctggtggcagtcatcggtaagatgccgcaagcgttggggaaactctggttacttgtcagcatggcgctcggcgtcattttcgtctggatgatgacctgcgtgtatcaaatcgacacagtgccaacctggcataacggttacactacgctggctttcttcctgacagtattgttgagcggtccaatacttgctgccgcaattctgcgggcagcccgcattacatttaataccacaccctttgccatcattagcgttctggcgctgatcgcttgtgccggggtgattgtgctgcaaggtttgtctctggcgtctattcactcatccgtacaacaagccagcgcactggtaccagattacgcctccttacaggtctggcgtgtggtattgttatgcgcaggtctaggatgctggctttgtccgctcattcgtcgccgtgaacctcacgttgccggacttgttctggggctaatcctcatacttggcggtgagatgatcgggcgtgtgctcttttatggcctgcacatgacggtaggaatggctattgcaggttaacaaattggtgcggggcaacccgcacatttcaggatgttaggaatgacccatttttcacagcaagataatttttctgtcgcggcgcgcgtgttgggcgcgctgttttattacgctccagagagtgcggaagccgcacctctggttgcggtactcacccgtgacggctgggaaactcagtggcctctaccagaagcgtcattagcgccgctggtgacggcttttcaggcacagagtgaagagactcgcgcccaggcctggcagcgtttgtttgtcggtccgtgggctctgccatcaccgccgtgggggtcggtctggctggatcgcgaatctgtgctgtttggcgattcaacattggcacttcgtcagtggatgcgcgagaaaggcattcagtttgaaatgaagcaaaacgaaccggaagatcattttggttcactgctgttgatggctgcgtggttggcggagaatggtcgccagacagaatgcgaagaattgctggcatggcacctttttccgtggtcaacacgttttcttgacgtttttatcgaaaaagcagaacaccctttctaccgtgcactgggtgaactggctcgcttaacgctggcgcaatggcaatcacaactgttaattcctgtcgcggttaaaccactctttcgataggatcaccgtaatattgccggatggtgtcgattaggcgcaattcggcaataataggttacagtgtcacgttttttatctcttaaagcacgcactgcttttgcgtctggcttcttttgccgcaaaatagtcgcccgtatttcattgcccatttctgctcatgcatcatctacacatctatccggatctgcgcactatgttccgccgtctgcttatcgcaacagtcgtcggtattcttgcggcctttgccgttgccgggtttcgtcatgcaatgctgctactggagtggttgttcctcaataatgactcgggcagtctggtcaatgcagcgacaaatctttccccctggcgacggctgctaactccggcgctcggcggactggcggcgggtttgttgctgatgggctggcagaaatttacccagcaacgccctcatgcgccgaccgattacatggaagcgttgcaaaccgatgggcagtttgattacgcagcaagcctggttaaatcccttgcctctctgctggtagtaaccagcggcagtgcaattggtcgcgaaggtgcgatgattcttttagctgcccttgccgcctcctgttttgcccaacgttttacgccacgccaggagtggaaattatggatcgcctgtggagctgcggcgggaatggctgcggcctatcgcgccccgcttgctggcagtttatttatagccgaagtgctgtttggcactatgatgttggcctctctcggcccggtgattatttccgccgtcgtggcattgctggttagcaatctgattaatcatagcgacgcgttactctacagtgtacaactctcagtgacggttcaggctcgtgactatgcgctgattatcagtacaggtgtgctggcaggtctgtgcggaccactgttgttaacgttgatgaacgcctgtcatcgtgaatttgtaagtctcaagcttgcgccgccctggcaactggcactgggcgggttgatcgtgggtctgctttccctgttcacacctgcagtgtggggcaacggctatagcaccgtacaatcctttttaaccgctccgccactgttaatgatcattgccgggatcttcctctgtaaactgtttgccgtgctggcgagtagtggttctggcgcgcccggtggtgtctttacaccgacgctatttatcggtcttgccattggcatgttgtatggtcgtagcctgggattatggttccctgatggcgaagaaattacgcttttactcggattgaccgggatggcgacactgttggcggcaaccacgcacgcgccgattatgtcgacgttgatgatatgtgaaatgaccggggagtatcagctactccccggtttattgattgcctgcgtaattgcgtcggtaatttcgcggacgttacaccgtgactctatctaccgccagcacactgcgaagcatagctaagcggatgtattgccccagttcacgctgttcggcgcgcggcagataaggcagttcaccaatgagcggtgccggaagttttttaccgagcacatcaatgatttccgcataatgcgccagtcctggattgattcggttagccacccagccaatgagcggtagcccgtcgttggcgatcgcctgagctgttagcagtgcatggttaatgcaaccttcctgaataccgacaaccatcaacaccggcagttgttcctgcaccacccattcagagagcggacgcaaatcattcatcagactgcgccagccgccagtcccttctaccacgacatgatcgactttatcggtcaggtttgccaggccgtttgaaatgagggtgtaattgattgggcaactgtgcgccacgctactttcttcttcgcttaacgcgataggattaactgcttcataaggcagttcgatggttgaaacactctgcaacaccagggcatctttattacgcagcccttcgggtgtctctttgctccccttcgctacgggtttatatcccgcaaccgtttttccctgggaggctaacgcttgtagcaatgcgcgggaaaccaccgttttccctacagaagtgtctgtaccggtaataaagaaacgcttcagcatcactaactccaccgttatgcttcacaaatataaaccaggaaaataattaaccttgaaagtctaagttatgctttcctggcccaaattgagatagcgcaaattttggtagaacagttaaaaaatgttaaccctgcaacagacgaatcaacaaagaaccgttatacatcgcgtcttttaccagcgcagcccctgccatcgtgccctggttagaaaactgagtactctcaacgctaatgtgctgactatacgcaggaagggcctgctgacggatgctatctgagatgaccgggaagaggatatctgccgctttacttaacggtgagccaatcagtattttttgtgggttaaataaattcaccatgatggcaagaatgcgccctacatgcgcgcccaccccggtaatgatgtcttttgccagcagatcgccgcgcaatgccgcctgacacaatgagtccacggttaacggttgtccatgtaacatcgagctcatggattgattgagacgcagctgtgccagctcaagaatactgtccacactggcgatggtttcgaggcagccgtgattcccgcaataacagcgtttcccatacgggtcgacctgcgtgtgacctatttccacaaggctactgctgcctgcgtgtagcagatgaccatcggtaatgacgcccgcccccacgttgtgatcgataaccacctgaatcacatcgcgcgccccgcgtgaggcaccaaacaaggcctcagccatcgtccatgcgctgatatcatgctgaatataaaccggtacgccggtatgctgctccagcgcctcgccgagcggcatctcttttacatcctcgtagaacggcatgcgatgtacaataccattttccgtatcaataattcccggcaaggtaatggcaatcgaagtcagacgctcaagttttttctggtggcggataaaaaactgatcgatatgggaaatgatacgatccagcaatggtgagtcatcttttaacgccagttcctgcgcctcctccaccaccagtttgctgctcagatcgcgcagagcaaggaaaatctccccgcgactaatgcgcagagaaagatagtgccaggcttcagtttcaaccaccagccccactgccggacggccacggttccccgcttctttgatttccagctcttgcaccaggtgtgcttcgagcatctcacggacaattttagtgatactggcaggagccagctgcgccagacgggaaagatcgatacgcgagactggaccaagctgatcaatcaggcgataaaccgcgcccgcgttggtctgctttatttgatcaatgtgcccaggctgattttcagcaaccaccgcatactccctatattttcgcgctccgaaataatctgtaggctatggtgaagcacttcaatacgtgtcgtcaaatttttacttaggcatgtgattaacagcacatttttcgggctttttcgctgaaatttccctcacctgagagcattcagcagatgaatacgaaagttacgcgcagccggactttgttcatggtgtttcggccagaccaaccacatttcagaaaccgcatcctcttcagcaatcggcacccagcgcatttcgttgagctgaacacgtttaaatgacgcaggcaaaattgaaacacccagaccagcggaaaccagaccgatgatggtcattgcctcacccacctcctgagtgatgacgggcgtcaaattgtaacgtcgcatcagcccgagaatatcgtcatacagccctgtccctacgtgcggatcaaaaaagacaaagggttctttcgccagttcagccagcgttacactcgggttatttgccaggggatgatcgtgcgggatcatcgccataagcggttcatggacgatgactgcgtgttcaagcgtctccggtaacgctgtgttacgcagcaatcccatatccagcgttccttcaatgagcggagcgatttgctcgcgagtgttcatttcgcgggtttgtaaatggacatcgggataatcacggcgaaacagcgataacgtatcggacaccgcccgaataaaaggagcggacgaagtaaaaccaatgcgcaactcccccgcttcgccctgatgcagcctttcagcgcgagcggcagcatcatccaccatagacaagatttgccgactatctacaagaaactgttttcctgctgccgtcagcaatacactgcgattggtccgtgccagcagtcgggcaccaatttgttgctccagcgcctgaatctgttgacttagcggtggttgcgaaatattcaggcgggcagcggcgcgcccgaaatgcagctcttctgcaaccgcaacaaagtaacgcagatgacgaagttcaatattcatatttaaaacatcttatttgagattattaatatattagacagaacaattcgattttcctaatctattcataagcctgatccacaggcatatttagcaaggatttcaagtgagccgtactacaactgttgatggagctccggcaagcgacactgacaagcaaagcatttctcagccaaatcaatttattaaacgcggtacgccgcaatttatgcgtgtcaccctggcgcttttctctgccggactggcaaccttcgcacttctctattgtgtgcaacctatccttccggtgctttcgcaggagtttggcttaacgcctgctaacagtagtatttcactgtccatttcaacggcgatgttggctatcggtttgctgtttactggcccgctatccgatgccattggtcgcaaaccagtgatggtcacggcgctactgttggcctccatttgtacgttactttcgacaatgatgaccagctggcacggcattttgattatgcgcgccttgattgggctttcgttaagtggcgtggcagctgttggcatgacttatcttagcgaggaaatccaccccagtttcgtggccttttcgatggggttgtatatcagcggcaactcaattggcggcatgagcggacgcttaattagcggtgtcttcacggactttttcaactggcgaattgcgctggcggcaatcggttgtttcgcgctggcctcggcgttaatgttctggaaaatcctccctgaatcacgccattttcgcccgacttcgctgcgacctaagacgttgtttatcaactttcgtctgcactggcgtgaccggggattaccgttattgttcgcagaaggctttttgctgatggggtcgttcgtcacgctgtttaattacatcggctatcggttgatgctctccccctggcatgtcagccaggccgtggttggcttattatcgctggcttatttgaccggtacatggagctcacccaaagccggaacaatgaccacccgctatgggcgcggtccggtgatgttgttttcgacgggggttatgctgtttggtttactgatgaccttatttagctcgctgtggctgatctttgccggaatgttattcttctcagccggattcttcgcagcccactccgttgccagcagctggatcggcccccgcgcaaaacgcgctaaaggccaggcctcctcgctgtatctgttcagttactatctggggtcgagtattgccgggacgctgggtggtgttttctggcataactatggctggaacggcgtcggcgcatttattgctctgatgctggtcattgctctgctggtcgggacgcgtttgcatcgtcgtctgcacgcctgaaaaataagtccggactgcggtaaatacccatccggacttattgcctgctcaaaccaacgttaatagccatcctaaaatagacgaagcgccagccaattcccgcagcgcatctagcgtcatcaggactataagtacccaaataaacggattcattttgctgtgtgtcatttattactgatgcgcagttattctaccgctttgtaagtagtaaaatagttaacctgatcaagactactattattggtagctaaatttcccttaagtcacaatacgttattatcaacgctgtaatttattcagcgtttgtacatatcgttacacgctgaaaccaaccactcacggaagtctgccattcccagggatatagttatttcaacggccccgcagtggggttaaatgaaaaaacaaattgagggtatgacaatgaaaaaagtattagctctggttgttgccgctgctatgggtctgtcttctgccgcctttgctgcagagactgcgaccacacctgctccgactgcgacgaccaccaaagcagcgcctgcgaaaaccacacatcataaaaaacagcataaagcagcacctgcccagaaagcgcaggcggctaaaaagcatcataaaaatgcgaaaactgaacagaaagcccctgaacaaaaagcgcaggcagcgaagaaacacgccaagaaacacagccatcagcaaccggcaaaacctgctgcacaacccgcagcgtaagttttcaacagtaatactggcgcgccccctcgcgcctgaaaattacggtgctaagcgggtaacgtttagcaccgcctttagcggagggtagtatggtgggccgttatcgctttgagttcattcttatcatccttattttatgcgcactgattgccacccgtttttatctttcctgatcgtagttatctgattttactcccactttcatcccgtcccgtctatagtatttatgagggtttgcttttaataatcataattacccaccagagtgtgatatgcgtacaaccattgctgtagtgttgggtgcaattagtttgacgtctgcttttgtgtttgcagataaaccagacgttgccaaatcggcaaacgatgaggtcagcaccctgttttttggtcatgatgatcgtgtgccagtgaatgacacgacccaatcaccgtgggatgcggttggccaactggaaacggccagcggcaatttatgtacggcgacgctgattgcacccaatctggcattaacggcaggacactgtttattgacgccgccaaagggtaaagccgataaagcggtagcgctgcgtttcgtgtcaaataaaggtctttggcgctatgagatccacgacatagaaggccgcgttgatccgacactgggaaagcggttaaaagcagatggggatggttggattgttcctcccgcagctgcgccgtgggacttcggtttgattgtgctacgtaatcccccttctggcattacaccgttgccgttatttgagggagataaagccgcgcttaccgccgcattaaaatcggctggccgtaaagtgactcaggcaggataccctgaagatcatctcgatacgttgtacagtcatcaaaactgtgaagtgactggctgggcgcaaacgtcggtgatgtcgcatcagtgcgataccttgccgggtgacagcggttcgcctctgatgttgcataccgatgacggctggcaattaattggggtgcaaagttcggctcctgccgcgaaagatcgctggcgcgccgataaccgggccatttctgttaccggttttcgcgacaggctggatcaactgtcgcaaaaataatgttcaaacgctgcccgacagcgcgggcagcgtgttcatcaggcaagtttcaccatgatcattccagccaacagcaagaccaggccaatccagcctttacgatttaaccgttgaccaaacaagatccaacctgcggctaacgtggcggcaataccaaacccgccccacaatgcataagcgacagacaagtcgatccctttaacggcctgagaaagcgcactaaaggcagccagcaccgccgccagggagagcaagccaaatattttgcgacgaaagccgtcagaaaatttcaaaaagacgttagcaacgatttccagcacgattgccaatgccagccaggcggcgtgaacccattcaaactgcgccatggttcacctccagttcaggtttacgcgctttacgggtacctgatttgatcaatacaatcccggcgaccagggtggttaacccggcaattttcatcagcgataaactttcgtcgaataacaaaacactaaacaaggtaataaataaaataccgataccttcccacagcgcataagccacgcctaaggcgatctttttaacggcgaaagagagaaatatatacgacagagaaatcatcaccagcattaaaataaagccgccatttccctcactgacgctcgcccatttcatagacagcgtaccggtaatttctgtagcaatagccagacctaataaaatccaataaatatacattgtccttctcctgcaagagaattattttaattttcgcttaattcagcgaaaccaaagtaaagtggtcaagccccgcgcatagcgcaagctttggcagaagaaaggactaaagcgcgttgcgccagtgctgctcacctacgagcaagatagtggatgaggtacgaagatgggtaaatgtagaaaataacgtcctgaacaaattgtccataatattacaattatccgcagtgttgcttctcgtcatcgcggatgataattgtcctcggtagttgaacacgcctgatttgtatcatagcttaagaattaactcaaaatattttcacttctttacctgagcggtttgattttcgttatgatgacggagcgaaatagacattattattagcaaaggaagaaaaaacggggacaagcatggcaaagccgatcatcacgctcaatggcctaaaaatcgtcattatgttgggaatgctggtcattattctctgcggtatccgttttgccgccgagatcatcgtgccgtttattctcgcattatttattgctgttattcttaacccgctggtgcaacacatggtccgctggcgagtgccgcgtgtactggcggtgtcgattttgatgaccatcatcgtgatggcgatggtgttgctgttagcttatctgggttccgcactcaacgagttgacgcggacgttaccgcaatatcgcaactctattatgacgccgctgcaagcgcttgaaccgttgttgcaacgcgtagggattgacgtctcagttgaccagctggcgcattacattgatccgaacgcggcgatgacgttgctcaccaacttattgacgcagttatctaatgccatgtcatcaatatttttattgctgctgacggtgctgtttatgctgctcgaagtgccacaattgcccggaaaatttcagcaaatgatggcgcgtccggttgaagggatggcggcgattcagcgtgcgattgacagtgtgtctcattatctggtgctgaaaacagccatcagcatcatcaccggcctggtcgcctgggcgatgctcgccgcactcgatgttcgcttcgcttttgtctggggattgctggcctttgcgcttaattacatcccgaatattggttcagttctcgcggcaatcccccctatcgctcaggtactggtgtttaatggcttctacgaagcgttgttcgtgctggcgggatatctgctgattaatctggtcttcggcaatattctggagccacgcatcatggggcgtgggctggggctttccacattggtggtatttttgtcgttgattttttggggatggttgttaggaccggtgggtatgctgctttccgtgccgttgacaattattgtcaaaattgcgcttgaacaaacagcgggaggtcaaagcatcgccgttctgttaagcgatctcaataaagagtgacggcctccgcagaggccgtcagggttacagagctttcaggattgcatccacgctggctttggcgtcaccaaacagcatgtgggtgttttccttgaagaacagcgggttttgcacaccagcatagccagtgttcatcgaacgtttaaagacaatcacgttctgcgctttccacacttccagcacaggcataccagcaatcggactcttcggatcatcctgcgccgccgggttaaccgtatcgttagcaccaatcaccagtacggtatcggtatcagcaaagtcatcattgatctcgtccatttccagcacgatgtcatacggtacttttgcttcagccagcaatacgttcatatgtccaggcaaacgccccgcaaccgggtggataccgaaacgcacgttgataccacgagcgcgcagtttctcggtaatttcagcgacaggatattgcgcctgcgcgactgccatgccgtaccccggagtaatgatcactgaatgggagtttttcagcagttccgctgtctcttctgcggtgatttcgcggtgctcgcccacttcctgatcatcgccagtagaagagccgtcggtgccgaaaccacccgcaataacgctgataaaggaacggttcatcgctttacacataatgtaagaaaggatagcgcccgaagaaccgaccagcgcaccggtcacaatcagcaggtcgttgctgagcataaagcccgcagccgcagccgcccagccggagtacgagttcagcatcgacaccaccactggcatatctgcaccaccgatggaggcgactaaatgccagccgaataccagcgcaatggcggtcattatcagcaatgccagcacttgcaggccgacgctgtccgtgcgaacaaatacaatcagcagcaggaaggaaacgaccagagccgccaggttcattttgtgacggtttggcagcatcaacggtttagacgaaatcttgccacacagtttgccgaacgccaccaccgaacccgtgaacgttaccgccccgatgaagataccgaggaacacttccgtcaggtgaatattgaccagaatcggtgccattcccgcgtcatgatgcagatagctgttaaagccaaccagcactgccgccagacccacgaagctatgcaggatcgccaccagttctggcatttcggtcatttcaactttcttcgctagccggataccaattgccccaccaatgaccatcgccagcaagatccagccaacattacccgtatccggtccaaaaatggttgcgattaacgcaatcgccatcccggcgataccgaagttgttaccctggcgagacgtttcatgtttcgaaagcccggccagactgaagataaacaggatcgcggcaacaatgtatgcagctgtaactaatcctccagacatatgttaccccttaatttttgcggaacattttcagcatgcgctgagtcacggtgaagccaccgaaaatattaatgctggctataagcaccgcgataaaactaaggaagctaacccagccgccctggccaatctgcaacagtgctccgacaacaataatccctgaaatcgcgttggtgaccgacatcaacggtgtatgcagcgcgtgcgatacattccacaccacgtaataaccgacaacgcaggccagcgcgaacacagtgaagtgcccaaggaattctttcggcgcaacgcttgccatccagccaaaaagaatgattgccagcgccatcaacgcgtatttacgccacggtgagcaggtacatttttcctcagttttcacttccggtgccgctttttgtgccgcctgcggctgagctgatacctgaatcggcggtgccggccaggtaatttcgcccgcacggatcacggtcacgccgcgaatcaccacatcatcaaaatcaacagtgatgttgccatctttctctttgcacaacagtttcagcagattaacgaggtttgtgccgtaaagctgtgaggattgcgtcggcagacggcccggaagatcggtataaccaatcactttgacaccattttccgtagtgaagatttcacccggcacggtgtattcacagttaccgccgttctgggctgccaggtcgacaatcacactgcccgccttcatggagtcaaccatttcacgggtaattagcttcggcgctggtttgcctggaataagcgcggtggtgacaatgatatcgacctcttttgcctgggcggcaaagagttccatttccgctttgatgaacgcgtccgacatcactttggcatagccatcgccgctgcccgcttcctctttaaaatccagctcgaggaattccgcgcccatactttgaacttgttctttcacttccgggcgggtgtcgaatgcacgcacaatcgcgccgagactgtttgctgcgccaatggcggccagacctgcaacacccgcaccaatcaccatcacttttgccggtggcactttcccggccgcagtgatttgcccggtaaagaagcgcccaaattcatgtgctgcttcaacaatggcgcgataaccggcgatgttcgccatcgagcttagtgcgtccagcgattgtgcgcgtgatatacgcggcacagagtccatcgccatcacggtcacgttacgttccgcaagtttttgcattaattccggattctgcgcaggccagataaaactcaccagcgttgtcccaagattcagtaacgcaatttcatcatctaacggcgcattgaccttcagaatgatctctgactgccagacgctattcccttctacaatttcagcgcccgcttgcacaaacgctttatcgtcaaaacttgccagttgacccgcgccgctctctaccgcgacggtaaaacccagtttcagcagctgttccactgtttttggcgttgctgcaacacgggtttcattggttaaccgttctcttggtatgccaattcgcatgatattcccttccatcggttttattgatgatggtttgcctgtgtcaggagccacacaagccgctcatgtacgagctaaatgttactccgttaaaataaattagtaacaaacgccctataacgtactgaaaattatgcctgtgatctagcgccaaaaatcagtatttcggcgtgaactcgcaaaatattaacgattcagccgtgatagtgggataaacaccttagaacgccggataaagactgataattgtcttcgacggtcaggtaaaacgagacatcgccccagtacgaatcactacttaacattaaattaacttatacaattcagttgcttcagtagtattgatgctgatacggctgttttttaagcatagacggtcatttgagcaggattaaaattggtttaaggaatgtgatatgaaaaatgacgcagacagttacaccgtttaaatgcaataatcagccacgtttctcgttaataacaataccagtacctggtttgcgcaaggcgaaggattatttttatgaagcttaagaacaccctcctggcgtcggcactgctttctgctacggcattctccgttaacgcagcaacagaactgacaccggagcaagcggcagcggttaaaccttttgaccgtgtagtggttaccggtcgttttaatgctattggcgaagcggtgaaagccgtttctcgtcgcgcagataaagaaggtgccgcctctttttatgttgtcgacacttctgattttggtaacagcggtaactggcgtgtggtcgctgacctctataaagccgatgctgaaaaagcagaagaaacaagtaatcgcgtaattaacggagttgtcgaactgccgaaagatcaggccgttctgattgaaccgtttgacacggtcaccgtccagggcttttatcgtagccagccagaagtcaatgatgccatcaccaaagcggcaaaagcgaaaggtgcctactcttactacatcgttcgtcaaatcgatgccaaccagggcggcaaccagcgtattactgcattcatctataaaaaagatgcgaagaaacgtatcgtccagagcccggacgtaatcccggcagattccgaagcaggacgtgcagctctggctgccggtggcgaagctgcgaagaaagttgagatcccgggtgttgcgactaccgcatcaccaagctctgaagtcggtcgcttctttgaaacccagtcatcaaaaggcgggcgttacactgtcacgcttcctgacggcactaaagtcgaagaactgaacaaagcgaccgcagcgatgatggtcccgttcgacagcatcaaattctctggcaactacggcaacatgactgaagtctcctatcaggttgcgaaacgtgccgcgaagaaaggtgctaagtattaccacatcacccgccagtggcaggaacgtggtaataacctgaccgtcagcgcagatctgtataaataactattcagttactcctataaggcggcttgatgccgcctttcgcatttttagtcacaaatttccccgcgaccattgcatgcagacacatctcttcgtaaaatcccgcgcttcagtggcaaactccatttttatgcgttttgccctaatatttattcttcttatcacgttttaatcactggatatcgatggaaaagaaactgggactgagcgcactcaccgcgctggtattaagctcaatgctgggcgcgggtgttttcagtctgccgcaaaatatggcggcagttgccagcccggcagcactgctcatcggctggggtattactggcgcaggcattttattgctggcctttgccatgctgatcctcacgcgcattcgtcccgaacttgacggcggtatctttacctatgcccgcgaagggtttggcgagctaatcggcttttgttccgcatggggatactggctgtgcgcggtcatcgccaacgtctcctatctggtgatcgttttttccgcgttaagcttttttacggacacgccggaattgcgcctgtttggcgatggtaatacctggcaatcgatcgtcggtgcatcggctttattgtggattgttcactttttgatcctgcgcggggtgcaaaccgctgccagcattaacctggtggcaacactggcaaaattgttgccgctgggtctgtttgttgtgctggcgatgatgatgttcaaactggataccttcaagctcgacttcaccggacttgcacttggcgtacccgtttgggaacaggtgaaaaacaccatgctgatcaccctgtgggttttcattggtgtggaaggtgccgtggttgtttctgcgcgtgcgcgtaataaacgtgatgttggcaaagcgacactgctggcggttctctccgctctgggcgtttacttgctggtaacgctgctttcgctgggcgtggtggcacgtcctgaactggctgaaattcgtaacccgtcaatggccggtctgatggtggaaatgatgggaccatggggcgaaatcatcatcgctgccggtttgatcgtttccgtttgcggcgcgtacttaagctggaccatcatggcggcagaagttccgttcctggcagccactcataaagcattcccgcgcatttttgcgcgccagaacgcacaagctgcgccatccgcttcactgtggctgaccaatatctgcgtgcaaatttgtctggtactcatctggctgaccggttccgattacaacacattgctgaccatcgcctcagagatgattctggtgccctatttcctggtcggcgcgttcttgctgaaaatcgcaacccgtccactgcataaagcggtaggtgtcggtgcctgcatttatggcttatggttattgtacgcctctggtccaatgcacttgctgttatccgttgttctgtatgcgccggggctgctggttttcctgtatgcgcgtaaaacgcatacacatgataatgtactgaaccgtcaggaaatggtgctgattggcatgctgttaattgcctcagttccggcgacctggatgctggtgggataacgttcatcccatcgttggatagcaaaggagataacgatgggtaaaacccagcccttgccaatattaattactggcggaggtcgtcgcatcggcctcgcactcgcctggcatttcattaatcaaaagcaaccggtgattgtcagctatcggacgcactatccagccattgatggactaattaaggcaggtgcgcagtgtattcaggctgatttttcgaccaacgacggtgtgatggcgtttgccgatgaagtactaaaaagtacccatggtctgcgtgctattttgcataacgccagcgcgtggatggcggaaaaaccgggtgcgccactgtccgacgtactggcttgcatgatgcagatccacgttaataccccatacctgctcaaccatgcgctagaaagattactgcgtgggcacggacacgcctccagcgatatcattcactttaccgattatgtggtggagcgcggtagcgacaaacatattgcctatgctgcaagcaaagcggcactggataatatgactcgctcgtttgcccgcaagctggcaccggaagtgaaagtgaattctattgcgccatcgctgatcctgtttaatgaacatgatgatgccgaatatcgacaacaggcgctgaataaatcactgatgaaaaccgcgcctggcgagaaagaagtgatcgacctggtcgattacttacttaccagctgctttgtcaccggacgcagtttccctcttgatggcggtcgtcatctgcgttaatgcagctttatccagcatataatcaacacccatgcgcttatcccccaacacgcaacagaaccaacaaaagcggcgggcaagcgcatcattccggtgaaataccacagcgacgccaggtaaacaaaatagggaataatcgaccacatgctaaaaatgatggttgcgcgtaaggcttcaatgccgcgttcgctggcaacaatataatgcgcgatgagcgcaaaggtcgggaaaagtgggatcagcccggcgatataataatttttcgtttttgctaaaacaccaatcaacagcactaccagcgcaccgagcgcggctttgattaccagccccatctttttaccttaacacttccataacaagtcatcagtagaatacctgatgaaaacttgtttagaaacgattgatagtaagtaaaaacagcgcggtgtattgtgacgtttttatatctaccgtgaataatatgaacactatcgtatttgtggaagatgatgcggaagtcggttcactgattgccgcgtacctggcaaaacatgatatgcaggttaccgtagagccgcgcggcgaccaggccgaagaaactattctgcgagaaaatccggatttggtgttactcgacatcatgctaccaggcaaggacggcatgaccatttgtcgtgatttacgcgcaaagtggtccggaccgattgttcttctaacctctctcgatagcgatatgaaccacatcctggcactggaaatgggtgcctgcgactatattctcaaaacgacgccccctgctgttttgttagcgcgtttacgtttgcatttgcgtcagaatgagcaagccacgctgaccaaaggtcttcaggaaacgtcactgactccctacaaagccctgcatttcggcacgttgaccatcgatcctatcaaccgcgtagtcaccctggctaacactgaaatctcgctctcgacagctgatttcgaattattgtgggaattagctacccatgccgggcaaatcatggaccgcgatgcattgctgaaaaatttacgcggcgtcagttatgacggactggatcgtagcgtggacgtggctatttcgcggttaagaaaaaaactgctcgataacgccgcagaaccttatcgcattaaaactgtgcgtaacaaaggctatctttttgcgcctcatgcatgggaataagcgatgaaaaaactgtttatccagttttacctgttattgtttgtctgcttccttgtgatgtctctgctggttgggctggtgtacaaatttaccgccgaacgcgcgggcaaacagtcgctggatgatttgatgaacagttcgctgtatctgatgcgcagcgaattgcgtgagatccccccacacgattggggtaagacgctgaaggagatggatttaaatctctctttcgatctgcgtgtcgagccgctgagtaaatatcatcttgatgatatttccatgcaccggctgcgtggcggcgaaattgtcgccctggacgatcagtacacgtttttgcaacgtatcccgcgcagccactacgtgctggcagttggtcctgttccttatctttattacctccatcagatgcgattactggatatcgccctgatcgcttttattgccatttccctcgcctttccggtgtttatctggatgcgtccgcactggcaggatatgttaaaactggaagcagcggcgcaacgatttggcgatgggcatctcaatgagcgtatccactttgatgagggttcgagctttgaacgacttggcgtcgcatttaaccagatggcggacaatatcaacgccttgattgccagcaaaaaacagcttattgacggtatcgctcatgaactgcgaacaccgttagtgcgcctgcgttatcgactggagatgagcgataacctgagcgccgccgaatcccaggcgttgaatcgcgatatcagtcaacttgaagctttaattgaagagctgctgacttatgcccgactcgatcgcccacaaaacgagcttcatcttagcgaaccagacctgccgttgtggctgtcaacgcatctggcagacattcaggcagtaacgcccgataaaacggtacggattaaaacgctcgcgcaaggccattatgcggcgttggatatgcgcttaatggagcgcgtgctggataatttgctcaataacgccctgcgctactgtcactcaacggttgaaaccagcctgctactgtcggggaatagagcgacattaattgttgaggatgatggcccagggattgccccagaaaaccgcgaacatatctttgaaccttttgttcgcctcgatcccagccgggatcgctcaaccggcggctgcgggctggggttggcgattgtccactctatagcactagcaatgggcggtacggttaattgtgacaccagcgaactgggtggtgcccgcttctcgtttagttggccgttatggcataacatcccgcaatttacctctgcttgacattacgcgcacgatggtcaagtcaccaccattgtgctataaattaaggatgttgtaactaaagtggttaatattatggcgcgttacgatctcgtagaccgactcaacactacctttcgccagatggaacaagagctggctgcatttgccgctcatcttgagcaacacaagctattggttgcccgcgtgttctctttgccggaggtaaaaaaagaggatgagcataatccgcttaatcgtattgaggtaaagcaacatctcggcaacgacgcgcagtcgctggcgttgcgtcatttccgccatttatttattcaacaacagtccgaaaatcgcagcagcaaggccgctgttcgtctacctggcgtgttgtgttaccaggtcgataacctttcgcaagcagcgttggtcagtcatattcagcacatcaatcaactcaagactacgttcgagcatatcgtcacggttgagtcagaactccccacagcggcgcgttttgaatgggtgcatcgtcatttgccggggctgatcacccttaatgcttaccgaacgctcactgttctgcacgaccccgccactttacgttttgggtgggccaataaacatatcattaagaatttgcatcgtgatgaagtcctggcacagctggaaaaaagcctgaaatcaccgcgcagtgtcgcaccgtggacgcgcgaggagtggcaaagaaaactggagagagagtatcaggatattgctaccctgccacaggacgcgaagttaaaaatcaaacgtccggtgaaggtgcagccgattgcccgcgtctggtacaagggagatcaaaaacaagtacaacacgcttgccctacaccgcttattgcgctgattaatcgggataatggcgcgggcgtgccggacgttggggagttgttaaattacgatgccgacaatgtgcaacaccgttataaaccacaggcgcagccgcttcgtttgatcattccacggctgcacctgtatgttgcagattaacgcccggctttcatactgccgaccatctgttctggccgtacccagctgtcaaactcggcttcgctaagataccccagcgcaagggctgcagcttttaaggtcagcccttctttatgcgcttttttggcgatctcggcggctttgtcataacctatgtgggtgttaagcgcagtcaccagcatcagcgattcattgagtaattgattgattcgctcacgattcggttcaatacccactgcgcagtgtttgttaaaactttccatgccatctgccagcaagcgcaccgattgcaggaaattgtggatcaccatcggacggaaaacgttcagttcaaagttaccggaagcgccacccatgttgatcgccacgtcgttccccatcacctgacagcaaagcatggttaatgcctcacactgtgttgggttcacttttcccggcatgattgagctgcccggctcattttccgggattgagatttcaccaattccacagcgcgggccagaggccagccagcggacatcattggcaattttcatcagtgacgcagccaaccctttcaacgcgccgtgcgcctgaaccagggcatcacaggtcgccagcgcttcaaatttgttcggcgcggtaacaaacggtgcgcaggtaatgactgccagttcatctgccacgcgacgcgcatactccggatgggtatttagtccagtacccacagctgtaccgcccatagccagttccgctacgtgaggcaggctgtattcaatatgtttgagattatgctcgagcatcgctacccagccggaaatctcctgccccagtgttagcggcgtggcgtcctgcaagtgggttcgaccgatttttacgatatcggcaaatgcacgcgatttttcactcagcgtctgtgtcagggttttaagctgcggaatgagttgcttgcgcagcgccagcagcgccgcaacgtgcatcgccgttggaaagacatcgttagaactttggcttttgttcacgtcgtcgttagggtgaactttacgctccatcccacgcacgccgccgagtaattcactggcccggttagccagcacttcgttcatgttcatgttactttgcgtgccggagccagtctgccagatagccaatgggaattcgtcgtcatgctgtcctgccagtacttcatccgccgcctgccgaatggcgctcgctttctcttcagacaacaagcctaaatcttcattaacttttgccgctgcgcgcttggttagcgccagcgcatgaatcagtgaggtgggcattttctccgtcgaaatgcggaaatgctccagcgagcgttgagtttgtgcgccccacagcttatctgccgggacatcaatcgcccccatcgaatctttttcgctgcgtactgtattcatggcctgctcctcacctgattaattttttctttctgttttgctttcgttaagcaacttttagctcactcattatttactatttgacaacaaatgtttggtctttcgtgccatgtaaaaaaaccgccccgaagggcggctctgtttatttcacacagcgggtgcactgtgtgagttgtatctgctggaagaagtcatttcctttatcatccacaaggataaacgccgggaaatcttccacttcaattttccagatggcttccattcccagttccggatattcaacacattccaggctcttaatactaccctgcgccaatacagcggccggaccaccgatactgccaaggtagaagccgccgtgttttttacaggcatccgtcacctgctggctgcggttgcctttcgccagcatgatcatacttccgccctgcgcttgcagttgatcgacataagaatccatccggccggcggtcgttgggccaagagaaccggaagcataaccttccggcgttttggccggacccgcgtagtaaatcggatgatctttaatgtactgcggcagcccttcaccgttatccatccgctctttcagtttggcgtgagcaatatcacgaccaacgataatcgtgccattcagcgataagcgtgtagaaacgggatactgcgacaactgtgcgaggatctctttcatcggacggttaaggtcaacgcgcaccgcttcgccttctcccgctttgcgcagctcttccgggatatatttgcctggattatgttccagtttttcgatccaaatcccctgacggttgatctttgctttgatattacggtcagcagaacaagagacgcccataccgaccgggcaggatgcgccgtgacgtggcaggcgaatcacgcggatgtcgtgagcgaagtatttaccgccaaactgcgcacccagaccaagattttgcgcttcgatcagcaattctttttccagttccacatcgcggaacgcctgtccgtgctcattcccttccgttggcagttcatcatagtatttagcggaagccagtttcaccgttttaaggttcgtttctgcagaagttccaccaataacgaacgcaatatgatacggaggacaggccgccgtacccagcgtgcgcatcttctcaaccaggtaatttttcagtttccccggcgttagtaacgctttggtttcctgatagagatacgtcttgtttgccgaaccgccacctttggcgatacagaggaatttgtactcgtcgccatcaacggcataaagatcgatctgcgctggtagattggtgccggtattcacctctttatacatatccagcggcgcgttttgcgagtagcgcagattatcttcgatataagtgttatagacaccgcgtgccagcgccgcttcatcaccgccaccggtccatacacgctgcccttttttaccaacaataatcgcggtgccggtatcctgacaggttggcagaacgcctttcgccgcgatgtcggagttgcgcaggaattgcagcgccacatatttatcattttcgctggcttccgggtcacgcagaatgtcggccacctgttgttggtgagccggacgcagcataaatgacgcatcatgaaacgcctgacgcgccaacaaagttaacgcttcgggtgcgactttcaaaatctcctgcccttcaaattcagatacgctaacgtgttcgctggttagcaggtaatactcagtatcatcttttttgagtggaaaaggagcctgataatgaaagggtttgtttgacattgttctctcacttactgcctggtttggttatgctctgggcgggtgttccgttgccctgttaaaagcgagtaacaatatcctacacacttttttaacaaaaactgagactagtacgactttttgcggctccaggttacttcccgtaggattcttgctttaatagcgggattaatttccacatataaacagggattgatcatgcaaaaactcattaactcagtgcaaaactatgcctggggcagcaaaacggcgttgactgaactttatggtatggaaaatccgtccagccagccgatggccgagctgtggatgggcgcacatccaaaaagcagttcacgagtgcagaatgccgccggagatatcgtttcactgcgtgatgtgattgagagtaataaatcgactctgctcggagaggccgttgccaaacgctttggcgaactgcctttcctgttcaaagtattatgcgcagcacagccgctctccattcaggttcatccaaacaaacgcaattctgaaatcggttttgccaaagaaaatgccgcaggtattccgatggatgccgccgagcgtaactataaagatcctaaccacaagccggagctggtttttgcgctgacgcctttccttgcgatgaacgcgtttcgtgaattttccgagattgtctccctactccagccagtcgcaggtgcacatccggcgattgctcactttttacaacagcctgatgccgaacgtttaagcgaactgttcgccagcctgctgaatatgcagggggaagaaaaatcccgcgcgctggcgattttaaaatcggcccttgacagtcagcagggtgaaccgtggcaaacgattcgtttaatttctgaattttacccggatgacagcggtctgttctccccgctgttgctgaatgtggtgaaattgaatcctggcgaagcgatgttcctgttcgctgaaacgccgcacgcttacctgcaaggcgtggcgctggaagtgatggcgaactccgataacgtgctgcgtgcgggtctgacgcctaaatacattgatattccggaactggttgccaatgtgaagttcgaagccaaaccggctaaccagttgttgacccagccggtgaaacaaggtgcagaactggacttcccgattcctgtggatgattttgccttctcgctgcatgaccttagtgataaagaaaccaccatcagccagcagagtgccgccattttgttctgcgtcgaaggcgatgcaacgctgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagcttattaaaggcttataacaccttcaggcggccagtccgcctgatttcattttatggataatcattatgaataaatcgctggtagcggtaggcgtcattgttgcgctaggcgtagtctggacaggcggcgcatggtatacaggcaagaagattgaaacccatctcgaagacatggtcgcgcaggcgaacgcgcaactcaaactgaccgctcctgaatccaacctggaagtgagttatcaaaactatcatcgcggcgtattcagcagtcagctgcaactgttggtgaaacccattgccgggaaagaaaatccgtggattaaaagcggtcagagcgtcatcttcaacgaatcggttgatcatggtcccttcccccttgcccagcttaaaaaactgaacctgatcccgtcgatggcatcaattcaaaccacgctggttaataacgaagttagcaagccactgtttgatatggcaaaaggtgaaacgccttttgagattaactcccgcattggttacagcggagattccagttccgatatttcgctcaagccactgaattacgagcaaaaggatgaaaaagtcgcctttagcggcggcgagttccagttaaatgcagacagagacggcaaagctatctccctttccggggaggcgcaaagtggtcggatagacgcggttaacgaatataaccagaaagtacagttgacctttaataatctgaaaaccgacggttccagcacgctggcaagttttggtgagcgcgtaggaaatcaaaaactgtcactggaaaaaatgaccatttcagtggaaggcaaagaactggcactgctggaaggcatggagatcagcggtaaatcggatctggtcaatgacggtaaaacgatcaatagccaactggattactcgctaagcagcctgaaggtacagaatcaggatctgggcagcggcaagctgactttaaaagtcggccagattgatggtgaagcctggcatcagtttagccagcaatataacgcgcaaactcaggcgctgctggcacagccagaaattgccaacaatcccgaactttatcaggagaaagtgacggaagccttctttagcgccctgccgctgatgttgaaaggcgatccggtgattactatcgcgccgctaagctggaaaaacagtcagggtgaaagtgcgctgaatctgtcgctgttcctgaaagatccggcaacgactaaagaagcgccgcaaacgctggcgcaggaagtagatcgttcggttaaatctctggatgcgaaactgaccattccggtggatatggcaactgagtttatgactcaagtagcgaagctggaaggttatcaggaagatcaagcaaaaaaactggcgaaacagcaagttgaaggtgcgtcagcaatggggcagatgttccgtctgaccaccttgcaggacaataccatcaccaccagcctgcaatatgctaacggtcagatcacgttaaacgggcagaaaatgccactggaagatttcgttggtatgtttgcaatgccggcattaaacgttccggtcgtacccgctcttccgcagcagtaattcacagccaaaacgccggaggtttttctctccggcgttatttcttacttcagcataaagtcatactgaatactcattttcacatcccagtaattcaggcgatcgcccagcgcactgccatcgcgcttttcccgccctttatcggcagcaagaaagaaattcatcccttgtaacggcccttcgctgacccgatagttcataccacctaagatacccgcgccttcaatccgcacatctcgtttactggattcatagccgcgagtcacaatcggtgcaaatgtcagcgtaaattgcggcgttaaacgatagttgacacccaattgccaggactgcattccttcacggttacgatcaagacttaatgaaaagggatagccaatgtcggtatccaccacggcaccattcattgcatggcgcaaataaccaccactgccaaatacgcttccccacggcgcattccaggtcaattgtccactaaccaacgccgtttcattgggctggctggtattacgacttaaaccttcgagctgcgcgtaaaagccgagcaactcccctttcaacgtataattcgggtcaagcggtatgcttttctcgagaatactttgtatctgattggatacatctttctgtaccgatgcccccagagaatagcgactggtatcatcatgccaactggcggctaaaaaagaacgtgcgcggtgtttatcgtattttcccgtctggctgttatacaccccttcatcacgaataccggttgttgaatcggtccataaaaatactcgtgaacgccacattccccacagatcaatatttggcgttaaagcccaataacctaatgctccttcagaaactgtcggtaatgtacgttgcgaactgccagccattaacggaatacgataaggtaagctaccataactataatccgtcccgaagcgacctaattttagcaggctattttcactgggttttatttttactgcccccagggcaaagccaaaacttttatcaccatcaagataccaccgggtactcatatcagcacgagcacctaatttataaacataatacgccccgccttcaacgccaataatattggaataataaccactattgaaatcgagcaatcctccctgtacccatgcgtaaatatctcttcccgcgccagcactgggcttatcagccctgcgcaattcgtttttcagtctgatgcgtagtcccgcttcatcgtcagccagttgcgccgcgtaagcagaggtaaggccagaggcagccgtcaggcaaataacggccatggccactatttttctcatagttgcacctttgatgttctgattatttttattgaatattaattagtgatatcgcggattaattgctgctgcatttttttacgattatcaatttcaaccacgatttctttgaattttttatccgtgagcggataaaaccagataatgacgaatgccagcagcataaatccgcaaggtactaaggcaattgatgtgcggatgcccataataacttccggcgcttgcacctgattggcaatatatccgcttaatcccaaaataaaggcaggaattgaacctccgattgcctgaccgcatttacgggtaaatgagaatagtgaataggtgagcccttctattcgcacgccggtcaggtattcaccgtattctacagtatcagcttccagtgcccacatcacggtcatggtaacgccctgaccaattgaagcgatggccaacgcaaccaacgccaccggcagtgaccagaccgaaacccagaagaacagcagataaccgcagcttcccagcaaagcgccaatcaggaaggtattctttttaccgatcctcgcgaccatccccggcaccagcggtgccgatgccacagtaccgaccaggttttgcaccagtaccagcacagtgaacagcccggtatcatttaacacatagcgcacgtagaacaacgacgaggcgctgaccgcgaaggtcgaaatcagcacacacagcgcaccgatgcacaacataaacagcgggcgattccgtttcagggtttgcagactgatcttcaatgacggctgcgccacgatacgtaccacattttcacgcgtcgatttgaagcagatgaagtaaagcaccattccggcaatcgccagcacaatcgtccagaaatggtataccgacaccatctcttccgggctagagttcttaatgctcggtcctatcagaaatgccaggcagacaaaggtcaatgaagcggcaatcccacgagccgcgcccagacgggcgcgggattgtggttgttgggtcattgcggtagcaagtgaaccataaggaatattcaccaggctgtagcaaagcccgaggcccatgtaggtcaaatatgcatacactactttgctgctatggctccagtcggtcggtgcccagaataccagcacgctgaagatcattaacggcgcggtaccgaagagtaaaaacgggcggaattttccccagcgggtattcacactgtccaccactcgtccggcaaagacgtcggcgaaggcatcgaatacccgcaccagtaacagcatggtgcccgccgcagcggcaccgacgccagcgacgtcggtgtagtaactcaacaggaagagcgcccccattgcgaaggcgaagttattggcgacgtcaccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgggtgaagatccctttcttgttaccgccaacgcgcaatatgccttgtgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagcagttctttttccagtaccttctctgccgtttccaaatcgccgctttggacataccaaccgtaataacggttcaggcacagcacatcaaagagatcgctgatggtatcggtgtgagcgtcgcagaacattacattgacacaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgcaatcagctctttaatcgcctgtaagtgcgcctgctgagtttccccgttgactgcctcttcgctgtacagttctttcggcttgatgcccgcttcgaaaccaatgcctaaagagaggttaaagcctacagctgcagtttcatcaatcaccacgatgccatgttcatctgcccagtcgagcatctcttcagcgtaagggtaatgcgaggtacggtaggagttggccccaatccagtccattaatgcgtgatcgtgcaccatcagcacgttatcgaatcctttgccacgcaaatccgcatcttcatgacgaccaaagccagtaaaatagaacggtttgtggttaatcaggaactgctcgcccttcactgccactgaccggatgccgacgcgcagcgggtagatatcacactctgtctggcttttggctgtgacgcacagttcatagagataaccttcacccggttgccagaggtgcggattcaccacttgcaaagtcccgctggtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggatcccggcatagttaaagaaatcatggaagtaagactgctttttcttgccgttttcatcggtaatcaccattcccggcgggatagtctgccagttcagttcattgttcacacaaacggtgatacgtacacttttcccggcaataacatacggcgtgacatcggcttcaaatggcgtatagccgccctgatgctccatcacttcctgattatttacccacactttgccgtaatgagtgaccgcatcgaaacgcagcacgatacgctggcccgcccaacctttcggtataaagacttcgcgctgataccagacgttgcccacataattacgaatatctgcatcggcgaactgatcgttaaaactgcccggcacagcaattgcccggctttcttgtaacacgctttcccaccaacgctgatcaattccacagttttcgcgatccagactgaatgcccacaggccgtcgagttttttgatttcacgggttggggtttctacaggacgtaacataagggactcctcattaagataaaaatactggtcaacctttaatctgattagttaaccaattctgtgttgcacacagttatctgtgagaaacccatggaagagaaatggaaataaaaagaactgacaccgcgatcaaaaaaccaaaaactgcaatacccacagcgtgatatagatcgcattaatctttaaaacggcgttgacagaagccataaaataagcaaccgaacgttcgttcgagcataatgggaacgataaactctcatgacgtatggctacagtgaatattttggggggaattctccgaacccgggaaggataatttttgcacagagaaattacgatatgaaacgcgggctcagttgtcaccagcccgcggaaagagagagaggatcaggatgcggttaagataccgccaatcatcgcgcgtaatccctgagcaaacgacgcttcacgcgccagatcttccgcttcgatatcggccagtacaccgtaggtcagatccagcagtaaacgtgaagtcattgccgtgttgatgtctgggcttatctcgcctttttgctgggcatcacgcatccgctgggcaacaaattccgtgatcgtcatatgcttatttttaagcatggcggcgacctgtgggttacgcatcccttccgccataatttcgaccaccagcgcccgttgtccaaaggcttcatgggtgagagagacaatagactcgaccatatagtcaacgaaatgaatcccttcaatcggttcccggaaacgggccagcgccctctcctggtcctgtaagataatcgcctgaatcagggcttctttggagatgaaatggtgatagagcgtcccgggactaatggcgcaagatttacagatggctttcatcgaggcactgtgaaatccattttctgaaaaaatctctctggcagcattgaggatccgggtccgtgtcggttgtgcttcagtctgcatgttatccatcataaaaccattatagttagcgtgaataactagtttaccgcgttgtcaggtgagcgcctatcattgctgttgaatagtgcgaaggcacactctattcgaatacttttcactcggaaattggttaaccaatagccgtgatttggctgccagttatttagctgagacgttgatgagtttatcccggtaaacaacacgcacggttgtttaccggtccgttagtgtattaattgagctcctgtaccccaccaccggagacggtgagaatttgtccgcttacccagctggctgcaggcgagcaaaggaacagcgccgcgttagcaatatcttgcggttggcccagacgtctaatcggtgtgtgctgtaacattttttgttcaatttcaggtgtaataacggatttcagggcatcggttaatattgcccccggcgcaatgccattcacccgaatatttttttcacccaggtcaaacgccatgtttctgaccagatgactggccgcagctttagatgatgcataggaggtcatgtttatatttttattttctgccgccatagaagtaatggtcagaataacgccaccgccatttttttccatttctggcgcaacaagttgtgacagatggaaaaaagaaaacacattcagttcataagcacggcgaaaatctgccattggcatatcaaacggtttaggaccaccgccaccggcgttgttaaccaggatatcaactttacccagcttactgacggcaaagtctgccagtgcagagagttcctgttcggaagtaatatcacaacggcaggcaaatgcctgaccacccagttgttgaatttcatcaacaacatggttagctgcgtcggcgttaatatcactgaccaccacagatgcgccagctgtcgcgaatgtaatggcaatttctttaccaatacctgcaccggcacctgtgatgatggcgcattttccgtcgagtctcaggttgtcagaattaaacacataaacctcctgtgaacttcagtaaaaataaaaggcaccgcctgtgtgccacattttttatcattaaccttgaggaaaggacactaccaggtatagcagataaagagagggttatttcgccgcaatgagccgggcgggaataataagattgcgtgaatgcgtctcttcatgggtgattttttgcatcatgcgatccgcaagtgtggtaccaagttcccgcgctggcgtgctggcccaggtaacaggtatatcatcaagtgtggttggcgttgcatcggtaaatgccgccaacgaaacctgttgttcaaagtaacgatcgactccgctttcaccgctttgccgccctgctttcagcaaaccaaaccatgcccccatcgcaatggtttcgttatagcaaaccacggcactgatggtcgggttatgacgtaaaagcgccgtgatagcttccgcggcttgcttctggctggaagtgcactccagcacccaatcgctgtgaaacggcaggccaaattttagtagagttgcacaatagccccccacccgttctgcccgggttaatgaggaactttgccctcccagccaggcgatacgctgatgcccattgcgaatgagatgctccgtcaacaactgtgcagcctgcatgttatccgggcgaaccgtatcaacatcatcaagataactggcacgggaagcgaaaatcaccgggatagctttttcttctgccatccgtcgcaggtcatcgctgcttcctgcagccccggcaattaccacaccatcgaccccctgattcagtaacagtgaaaaccgctgtgccaactgctcgccgtctttaccgccgtgaagcaaaaaaaccatccgtccctgcgcttccagagcttccgtcaatccggccgttaattcggcgtaaaacggcgcagataaatcacgaacgatcaaaccaatgacgccgctttgcccgccgcgcagcgccgacgcctgacgattgcgcacaaatcccagctcttcaatggcggcgttaacgcgttctcctgtggcggtagagattcgccctttgccacttagcaccagcgaaacggtacttaccgacacgcccgcagccagcgcaacatcatgaatggttatttttttggcggtagccatgcagatgacctactccctgattatgtgacagataaaacgttttaccttttatttatcttatacccgctattatcgttgcgtaatgtgatttatgcctcactaaaatttgataaaacgttttatcttctcgcgcaatttactgaatccagattgttctctacgaggagtcgttttatgacggcgaaaacagcaccgaaagtcacgctgtgggagttcttccagcagttaggcaaaaccttcatgttacccgtggcattattgtcgttctgcggcattatgctcggcattggtagttctcttagcagccatgatgtcatcaccctgatcccggtcctgggcaaccccgtgttgcaggctatctttacctggatgagtaagattggctcgtttgcttttagtttcctgccagtcatgttctgtatcgccatcccgctgggcctggcacgcgaaaacaaaggcgtagcggcattcgctggcttcgtcggttatgcggtaatgaacctcgcggtaaacttctggttgaccaacaaaggcattctgccaaccactgacgccgccgttctgaaagccaataacatacagagcattcttgggatccagtcgatcgataccgggatcctcggtgcggtgatcgccggtattatcgtctggatgctgcatgagcgattccataatatccgcctgccggatgcgctggcattcttcggcggtacgcgcttcgtaccaatcatctcctcgctggtgatgggccttgtcggtctggtgattccattagtctggccaattttcgccatgggtattagcggcttaggccatatgatcaacagcgcgggtgatttcggaccgatgctgtttggtaccggtgaacgtctgctgttgccgtttggtctgcatcacattctggtggcattaattcgctttaccgacgcaggcggcacgcaggaagtctgcggtcaaaccgtcagcggcgcactgaccatcttccaggcgcaattgagttgcccgaccactcacggtttttctgaaagcgccacgcgtttcctttcgcaaggtaaaatgcctgcgtttctcggcggcctgccaggtgcagcgttagctatgtatcactgcgcgcgcccggaaaatcgccataaaattaaaggtctgcttatttctggcctgatcgcctgtgtcgttggcggcacgaccgaacctctggaattcctgttcctgttcgtagcgccagttctgtatgtcatccacgcgctgttaaccggcctcggcttcaccgtcatgtctgtgctcggcgtcaccatcggtaataccgacggcaatatcatcgacttcgtggtgttcggtattttgcatggtctgtcaaccaagtggtacatggtgccagtggtggcggcaatctggtttgtcgtttactacgtcatcttccgtttcgctatcacccgcttcaatctgaaaaccccggggcgcgatagcgaagttgccagctcaatcgaaaaagccgttgccggtgcgccgggtaaatcaggttacaacgttccggcaatcctcgaagccttaggcggtgccgacaatattgtcagcctcgataactgcattacccgtctgcgtttgtctgtgaaagatatgtcgcttgttaatgtgcaggcactgaaggacaatcgggcaattggcgtagtacaacttaatcaacataacctgcaggttgttatcgggccacaagttcagtcagtaaaagatgaaatggccggtctgatgaatactgtccaggcataaggataagatatgttcgatttttcaaaggtcgtggatcgtcatggcacatggtgtacgcagtgggattatgtcgctgaccgtttcggcactgctgacctgttaccgttcacgatttcagacatggattttgccactgccccctgcattatcgaggcgctgaatcagcgcctgatgcacggcgtgtttggctacagccgctggaaaaacgatgagtttctcgcggctattgcccactggttttccacccagcattacaccgcaattgatacgcagtcggtggtgtatggcccttctgttatctacatggtctcggaactgattcgtcagtggtctgaaaaaggtgaaggcgtggtgatccacacacccgcctatgacgcattttacaaggccattgaaggtaaccagcgcacagtaatgcccgtcgctttagagaagcaggctgacggctggttttgcgatatgggcaagctggaagccgtgttggcgaaaccagaatgtaaaattatgctcctgtgtagcccacagaatcctaccgggaaagtgtggacgtgcgatgagctggagatcatggctgacctgtgcgagcgtcatggtgtgcgggttatttccgatgaaatccatatggatatggtttggggcgagcagccgcatattccctggagtaatgtggcgcgcggagactgggcattgctaacgtcgggatcgaaaagtttcaatattcccgccctgaccggtgcttacgggattatagaaaatagcagcagccgtgatgcctatttatcggcactgaaaggacgtgatggcctttcttccccttcagtactggcgttaactgcccatatcgccgcctatcagcaaggcgcgccgtggctggatgccttacgcgtctatctgaaagataacctgacgtatatcgcagataaaatgaactccgcgctccctgaactcaactggcagatcccgcaatccacttatctggcctggattgatctacgtccgttgaatattgacgacaacgcgttgcaaaaagcgcttatcgagcaagagaaggtcgcgatcatgccggggtatacctacggtgaagaaggtcgtggttttgtccgtctcaatgccgggtgcccgcgttcgaaactggaaaaaggtgttgctggattaattaacgccatccgcgctgttcgttaaccccaattgcgcaacgtaaaaaatcgttgcgcaatcgtggatttttaccctgctttgtttttataatggtgcgcacttttatatccagaaaaagagtgcgaccatgattgataccaccctgccattaactgatatccatcgccaccttgatggcaacattcgtccccagaccattcttgaacttggccgccagtataatatctcgcttcctgcacaatccctggaaacactgattccccacgttcaggtcattgccaacgaacccgatctggtgagctttctgaccaaacttgactggggcgttaaagttctcgcctctcttgatgcctgtcgccgcgtggcatttgaaaacattgaagatgcagcccgtcacggcctgcactatgtcgagctgcgtttttcaccaggctacatggcaatggcacatcagctgcctgtagcgggtgttgtcgaagcggtgatcgatggcgtacgtgagggttgccgcacctttggtgtgcaggcgaagcttatcggcattatgagccggaccttcggcgaagccgcctgtcagcaagagctggaggcctttttagcccaccgtgaccagattaccgcacttgatttagccggtgatgaacttggtttcccgggaagtctgttcctttctcacttcaaccgcgcgcgtgatgcgggctggcatattaccgtccatgcaggcgaagctgccgggccggaaagcatctggcaggcgattcgtgaactgggtgcggagcgtattggacatggcgtaaaagccattgaagatcgggcgctgatggattttctcgccgagcaacaaattggtattgaatcctgtctgacctccaatattcagaccagcaccgtggcagagctggcggcacatccgctgaaaacgttccttgagcatggcattcgtgccagcattaacactgacgatcccggcgtacagggagtggatatcattcacgaatataccgttgccgcgccggctgctgggttatcccgcgagcaaatccgccaggcgcagattaatggtctggaaatggctttcctcagcgcagaggaaaaacgcgcactgcgagaaaaagtcgctgcgaagtaacaaaaatggatggtgctaattgcaccatcctcttttcacgcaaggcacagcgtcgcgcgatgtttggcggattcgatgcccagctcaatcaactccattacctggattgcctgacttgccggaaccggattttcaccatcgccatttaacgcatcacgaatagccgcatagtaagccggataattccctggtactgtcaacagcgtttcttcgacacgttcctcaccttccacgcgggtaagtacgccatcacgcatatcgtagccccagtcttcctgcggcagacgctcgccatttttcagacgttcttcctgtggatcgaggccatatttcacataactgcctcgggatccatgcacgatataacgtgctgactcagcggctgccagcatggtgccgtgtaaaatgactcgccgctgcggataggacaagatggcgtggaaataatcggtcgactgcgctccgggccgtaactgtgccaaatctaccgtcatgctaaccggtaaaccaaatagcgtaatggcctgatcaagaaggtgcggtgctaaatcgtaccaaataccgctgccaggaccgccctgttcacgccaacgatcgcgcacctgcggacggaagcggtcaaaatgagactcaaagtaagcaacttcacccagtacgccttccgcgagcaaaccttttagcgtcaggaaatcgctatcccagcgacggttatggaatacagacagcacacgccccaggctttttgccagcgcttccagctcgcgcgcttgtgacagtgtcacggtaaagggtttatcaacgaccacatgtttacccgcctcaagcgccgctttggctaacgggaaatgggtatcgttgggtgtaggaatgacaatcaggtctatgttgggatcgttaaacagatgcttcggctcagagacaaccgtaaccgttggccagtcggcttttacttttgtttcatcgctgctggagattaccgccagttccagcccgggcgtgcccgcaatcaggggcgcatggaaggttttgctcgcataaccatacccaatcaacccaacacggatgttgtcgctcatgtcattgcctctcattgaagtatgatggctatttgacactatcctttaccctcgctcaacagtttaataacctgccagcaataagggatgttgtttaacttaagtcaaaaaaatagcgaattttccaacgacaaaagctaaatatcgcaaaaacctcagtaaaaatcttgctggagctattattgctaagtaacatttaccccctgaagttaatggatcaatcaacagagatgtgggctgtaatgaatcgtcttattgaattaacaggttggatcgttcttgtcgtttcagtcattcttcttggcgtggcgagtcacattgacaactatcagccacctgaacagagtactacggtacaacacaagtaagctctgcgcttgtagagcgacatgctgcccgtccgggtgcatgttttcacttgtcggatattaaaccaggaatttattatcttgttcgatgttgttggtgattgtcagagatagtaaagcgcgttactcttttcagagcagtttttcatccctgaatatttgccatcagcgcattcttattattgtaataacacaagcgttcacttttggtgaaattttatcatcactaataatacctacccctttggtattaattattttatggaccttttatgactgttcaggactacttattaaaatttcgcaaaatcagttcactcgaaagtctggaaaaactctacgaccatcttaattacaccctgacggacgatcaggaactgatcaatatgtatcgtgctgccgatcaccgtcgcgcagagctggtttctggcgggcgtttgtttgacctcggccaggtaccgaagtccgtctggcactatgtccaataaagaaagtagcgatcggttataaaagccttataataacgcccctaaaattagatttgcctgtttgcgtcgctattctggagaacctatgaccaccacaacgccacaacgtattggaggctggttgcttggcccattggcctggcttttagtcgctctgttaagtacgacgctggcgttgttgctgtataccgctgcgttatcttctccgcaaacatttcaaacgctcggcgaacaagcactgacgacacaaatcttatggggcgtttcttttattaccgctatcgccatgtggtattacacactgtggttgaccatcgctttctttaaacgtcggcgttgtgttcctaaacactatattatctggctgcttatttccgtattgctggcagtaaaagcgttcgctttttcacccgtggaagatggcatagccgttcgccagttactgtttactttgttggcaaccgcattgatcgtcccctattttaaacgctcgtcgcgggtgaaagcgacgtttgtgaatccgtaataaccttacagttaacctgttgtcgcctgctctggattaacggataataggcggcttttttatttcaggccgaaaaatgactgactacctgttactgtttgtcggaactgtactggtcaataactttgtactggtcaagtttctcggtctctgtccgtttatgggggtttccaaaaagctggaaaccgcgatgggcatggggctggctacaacgtttgtgatgacgctggcgtctatttgcgcctggcttatcgatacgtggattttgatcccgcttaatctgatttacctgcgcaccctggcgtttattctggtgattgctgtggttgtgcagttcaccgagatggtggtgcgcaaaaccagcccggtgctttaccgtctgctggggatttttttgccgcttatcaccaccaactgtgcagtgctcggcgtggcgttgctgaatatcaatctcgggcacaatttcttgcagtcggcgctgtacggtttttccgccgctgtcggtttctcgctggtgatggtgcttttcgccgccatccgcgaacgccttgctgtggctgatgtcccggcaccttttcgcggtaatgccattgcgttaattaccgcaggtcttatgtctctggcctttatgggctttagtggtttggtgaagttgtaatgaatgctatctggattgccgttgccgccgtgagcctgctgggcctggcgtttggcgccattctgggttatgcctcccgccgttttgcggtggaagacgatccggtcgttgagaaaattgacgaaatcttaccgcagagccagtgtggtcagtgcggttatcccggctgtcgcccctacgcggaagccatcagctgtaacggtgaaaaaattaaccgctgcgccccaggtggcgaagctgtgatgctaaaaattgctgagttgcttaatgtcgagccacagccgctggatggcgaagcgcaagagctaacgcctgcgcggatggtggcgtttattgatgaaaataactgtattggctgcactaaatgtattcaggcgtgtccggtagacgccatcgttggtgctacccgcgccatgcatacggtaatgagtgatctctgtacgggctgcaatttatgtgttgatccgtgcccgacgcactgcatctcgttgcaaccggttgcagaaacacctgactcctggaaatgggatctgaacaccattcccgtgcgtatcattcccgtggaacaccatgcttaagttattctctgcattcagaaaaaataaaatctgggatttcaacggcggcatccatccaccggagatgaaaacccagtccaacggtacgcccctgcgccaggtaccactggcgcagcgttttgtcataccactgaaacaacatattggcgctgaaggtgagttgtgcgttagcgtcggcgataaagtactgcgcggccagccgcttacccgtggacgcggcaaaatgctgccagttcacgcgcccacctcgggtaccgttacggctattgcgccccactctacggctcatccttcagctttagctgaattaagcgtgattattgatgccgatggcgaagactgctggatcccgcgcgacggctgggacgattatcgctctcgcagtcgcgaagagttaatcgagcgcattcatcagtttggtgttgccgggctgggtggtgcgggattcccgacaggcgttaaattgcagggcggcggagataagattgaaacgttgattatcaacgctgctgagtgcgagccgtacattaccgccgatgaccgtttgatgcaggattgcgcggctcaggtcgtagagggtattcgcattcttgcgcatattctgcagccacgcgaaattcttatcggcattgaagataacaaaccgcaggcgatttccatgctgcgcgcggtgctggcggactctcacgatattactctgcgggtgattccaaccaaatatccttctggcggtgctaaacaattaacctacattctgaccgggaagcaggttccacatggcgggcgttcatccgatatcggcgtattaatgcaaaacgtcggcactgcttatgcagtgaaacgtgccgttattgatggcgaaccgattaccgagcgtgtcgtgaccctgactggcgaagcaatcgcacgcccgggcaacgtctgggcacggctgggtacgccagtgcgtcatttattgaatgatgccggattctgcccctctgccgatcaaatggtgattatgggcggcccgctaatgggctttaccttgccatggctggatgtcccggtcgtaaagattaccaactgtctgttggctccctctgccaatgagcttggcgaaccacaggaagaacaaagctgcatccggtgtagcgcctgtgctgacgcctgccctgcggatcttttgccgcaacagttgtactggttcagcaaaggtcagcaacacgataaagccaccacgcataacattgccgactgcattgaatgtggggcttgcgcgtgggtttgcccgagcaatattcccctggtgcaatatttccgtcaggaaaaagctgaaattgcggctattcgtcaggaagaaaagcgcgccgcagaagccaaagcgcgtttcgaagcgcgccaggctcgccttgagcgcgaaaaagcggctcgccttgaacgacataagagcgcagccgttcaacctgcagccaaagataaagatgcgattgctgccgctctggcgcgggtgaaagagaaacaggcccaggctacacagcctattgtgattaaagcgggcgaacgcccggataacagtgcaattattgcagcacgggaagcccgtaaagcgcaagccagagcgaaacaggcagaactgcagcaaactaacgacgcagcaaccgttgctgatccacgtaaaactgccgttgaagccgctatcgcccgcgccaaagcgcgcaagctggaacagcaacaggctaatgcggaaccagaagaacaggtcgatccgcgcaaagccgccgtcgaagccgctattgcccgtgccaaagcgcgcaagctggagcagcaacaggctaatgccgagccagaacaacaggtcgatccgcgcaaagccgccgtcgaagccgctattgcccgggccaaagcacgcaagctggaacagcaacaggctaatgcggaaccagaagaacaggtcgatccgcgcaaagctgccgtcgaagcggctattgcccgtgccaaagcgcgcaagctggaacagcaacaggctaacgcagaaccagaagaacaggttgatccgcgcaaagccgccgtcgaagctgctattgcccgtgccaaagcacgcaagctggaacagcaacaggctaatgcggagccagaagaacagattgatccgcgcaaagcggcagttgccgcggctattgcccgcgttcaggccaaaaaagccgcccagcaaaaggttgtaaacgaggactaaatggtattcagaatagctagctccccttatacccataaccagcgccagacatcgcgcattatgctgttggtgttgctcgcagccgtgccaggaatcgcagcgcaactgtggttttttggttggggtactctcgttcagatcctgttggcgtcggtcagtgctctgttagccgaagctctcgtactcaaactacgcaagcagtcggtagccgcaacgttgaaagataactcagcattgctgacaggcttattgctggcggtaagtattccccccctcgcgccatggtggatggtcgtactgggtacggtgtttgcggtgatcatcgctaaacagttgtatggcggtctggggcaaaacccgtttaatccggcaatgattggttatgtggtcttactgatctccttcccggtgcagatgaccagctggttaccgccacatgaaattgcggtcaacatccctggttttatcgacgccatacaggttattttcagcggacataccaccagtggtggtgatatgaacacgctacgcttaggtattgatggcattagtcaggcgacaccgctggatacatttaaaacctctgtccgtgccggtcattcggttgaacagattatgcaatatccgatctacagcggtattctggcgggcgctggttggcaatgggtaaatctcgcctggctggctggcggcgtgtggttgctatggcagaaagcgattcgctggcatattcccctcagcttcttagtaacgctggcgttatgcgcaacgttgggctggttgttctcaccagaaacactggcatcaccgcaaattcatctgctgtctggtgcgactatgctcggcgcattctttattttgactgacccggttactgcttctacgaccaatcgtggtcgtcttattttcggcgcgctggcgggtttattagtctggttgatccgcagtttcggcggctatcctgacggcgtggcttttgccgtcctgctggcgaacatcacggttcctctgatcgattactacacgcgtccgcgcgtctacggccatcgcaaagggtaaaccatgctgaaaactatccgaaaacacggcattacactggcactatttgcagcgggttctacagggttaactgcggccatcaaccagatgaccaaaacgacaattgctgaacaggccagtctgcaacaaaaggcgttatttgatcaggtgctgccagccgaacgctataacaatgcgctggcacagagttgctatctggtcactgcgccagagttaggtaaaggtgagcatcgggtttacatcgccaaacaggatgacaaacctgtagccgccgttctggaagcaaccgcgccagatggctattctggtgcaattcagctgctggtgggagccgattttaacggcacggtactaggcacgcgcgtgacagagcaccacgaaacgccagggcttggcgataaaatcgaactgcgcctttctgactggatcacccattttgcgggtaaaaaaatcagtggtgcggatgatgcgcactgggcggtgaagaaagatggtggtgatttcgaccagttcaccggcgcgacgattactccccgcgcggtggttaatgcggtaaaacgcgccggattgtacgctcagacgttaccgtcacaactttctcaacttcctgcctgtggagaataaagcgtgagcgaaattaaagacgttattgttcaggggttgtggaaaaacaactctgcgctagtccagctgctcggcctctgtccgctattggcggtcacgtccactgccactaacgctctgggtttaggacttgcgactacgctggtactgacgctgaccaacttgaccatttcgacgctgcgtcactggacgccagccgagatccgcattcccatttacgtgatgatcatcgcctcggtggtcagcgctgtacagatgctgatcaacgcctacgcctttggcctgtatcaatcattagggatttttattccgctgattgtcactaactgtatcgttgtgggccgcgctgaagccttcgccgccaaaaaaggtccggcgctttcggcactggacggcttttcaattggtatgggcgcaacctgcgccatgttcgtgctgggttcactacgcgaaattatcggcaatggcacgttgtttgacggtgcagatgcgctgttaggtagctgggcaaaagtattacgcgtggaaattttccacaccgactcccctttcctgctggcgatgctgccaccaggtgcatttattggcctgggactgatgctggcagggaaatacctgattgatgaaagaatgaaaaagcgccgtgctgaagcagctgccgaacgtgcattgccaaacggtgaaacagggaatgtctgatgaacaaagcaaaacgcctggagatcctcactcgcctgcgtgagaacaatcctcatcccaccaccgagcttaatttcagttcgccttttgaattgctgattgccgtactgctttccgctcaggcgaccgatgtcagtgttaataaggcgacggcgaaactctacccggtggctaatacgcctacagcgatgcttgaactgggcgttgaaggggtgaaaacctatatcaaaactattggcctttataacagcaaagcagaaaatatcatcaaaacctgccgtatcttactggaacagcataatggcgaggttccggaagatcgtgctgcgcttgaagccctgcctggtgtaggtcgtaaaacagccaacgtcgtattaaacactgcattcggctggccgactattgctgtcgacacgcacattttccgcgtttgtaatcgtactcaatttgcgccggggaaaaatgtcgaacaggtagaagaaaagctactgaaagtggttccggcagagtttaaagtcgactgccaccattggttgatcctccacgggcgatatacctgtattgcccgcaagccccgctgtggctcttgtattattgaagatctttgtgaatacaaagagaaagttaacatctgaagaaaaggggtaacaccgattaccccattcataacctttctttatcctcttttaaaacatctttttaacgtcaatgatgccattgcttagcgttatcatcaggtaatccgtttgcggataaccaaaaatgcaggttaattgtttttttaatagcgaaattttctattcattcgtgatcaagatcacgatgctgtggcaatgtaaaaacattgcaagaattaggttaaaatcatttaaatttacacacgcaacaaatattgacctacaaaacattacactggctatttttcagaaactggactatctcactaggaaaaacgctaaatagcagaacatatcgccgttaagccatcatccccctctcagggtagtgaaaaaatctgccgttacgttttttgaaaaatttaacgctggataacatttcccggaatggttgaattccccgcctcagttatatgtaacagattattacaaaggacttgtctgaaagtgcaagatagtgaacattacctgccgtttcccctcccactataacaattgcgcgtatgttttttaggcataacgcgagaaagcacccccgttaatatgggatgtaaaaaaagaggtaaaagtgtccactgcaaaccaaaaaccaactgaaagcgtcagtttgaacgctttcaaacaaccgaaggcgttctatctcatcttctcgattgagttatgggaacgttttggttattacggcctacaaggaattatggctgtttacctggttaaacaactgggtatgtctgaagcggattcaatcacccttttctcttcctttagtgccctggtttatggtctggtcgctatcggcggctggttaggtgacaaggtactgggtactaaacgcgtaattatgcttggcgctattgtgctggcgattggttatgctctggttgcctggtctggtcacgacgccggtatcgtttatatgggtatggcggctattgcggtcggtaacggcctgtttaaagctaacccgtcttctctgctttctacatgctatgagaaaaacgacccgcgtctggacggtgcattcaccatgtactacatgtccgtcaacatcggctctttcttctctatgatcgccaccccgtggctggccgcgaaatacggctggagtgttgcgtttgcgttgagcgttgtaggcctgctgatcactatcgttaacttcgccttctgccaacgctgggttaaacagtacggttcaaaaccagacttcgagcctatcaactaccgtaacctgctgctgaccattattggtgttgtggcactgatcgctatcgccacctggctgctgcacaatcaggaagttgcgcgtatggcgctgggcgttgttgcattcggtattgtggttatcttcggtaaagaagctttcgcgatgaaaggtgctgcgcgtcgtaaaatgatcgttgccttcatcctgatgctcgaagcaatcatcttcttcgtgctgtacagccagatgccaacgtcactgaacttctttgcgattcgtaacgttgagcactccattctgggtctggccgtagaacctgagcagtatcaggcactgaacccgttctggatcatcatcggtagtccgattctggccgctatctataacaagatgggcgataccctgccgatgccaaccaagtttgcaatcggcatggtgatgtgttctggtgcgttcctgattctgccgctgggtgcaaaattcgcgtctgacgcaggtatcgtgtctgtaagctggctggtcgcaagctatggcctgcagagtatcggggaacttatgatctctggtctgggtctggcaatggttgcacaactcgttccgcagcgtctgatgggcttcattatgggtagctggttcctgaccactgccggtgcaaacctgattggtggttatgttgcgggtatgatggctgtgccggataacgttaccgacccactgatgtcactggaagtctatggtcgcgtattcttgcagattggtgtcgctactgccgttattgcagtactgatgctgctgactgcgccgaaactgcaccgcatgacgcaggatgacgctgcagacaaagcggcgaaagctgctgtagcgtaaaattcagggaaactcttttacaagccgctaacttttcgttagcggctttttttttgttcagcaacgcactaccatactttaaaccacagacaaaaggagttaccgatgaaattgttctacaaaccgggcgcctgctctctcgcttcccatatcaccctgcgtgagagcggaaaggattttacgctcgtcagtgtggatttaatgaaaaaacgtctcgaaaacggtgacgattactttgccgttaaccctaagggacaggtgcctgcattgctgctggacgatggtactttgttgacggaaggcgtagcaattatgcagtatcttgccgacagcgtccccgaccgccagttgctggcaccggtaaacagtatttcccgctataaaaccatcgaatggctgaattacatcgccaccgagctgcataaaggcttcacacctctgtttcgccctgatacaccggaagagtacaaaccaacagttcgcgcgcagctggagaagaaactgcaatatgtgaacgatgctctgaaggatgagcactggatctgcgggcaacgatttacaattgctgatgcctatctgtttacggttctgcgctgggcatacgcggtgaaactgaatctggaagggttagagcacattgcggcatttatgcaacgtatggctgaacgtccggaagtacaagacgcgctgtcagcggaaggcttaaagtaatagccatcggcccacaggtcgttgtgggccgaaatgagatatttcagagctttgttgcgctgaaataatgttctggtttggcaatacgatcctgagcagcaaccacttgcagctcatattcctgcattgctttggtggtcaccatgatttcgtatactgcagcggtcacatgttccagggcctcctgcagcgttgccccctgaagcagtttcaccagcagtaaaccgctcgtcacatcaccaacacctaccggctggcgcataccaaaatccaccagcggacggctgatatgccaggcttcatcggcggtaaccagcagcatttcaaaacggtcacggctgtagccagcccgcgccaggtgtttaaccaacacaatttgtggcccttgcgcaatgagttcacgcgctgccagaaccgcttcttcgacgttatttaccggatgctcacagagtatctccagctcaaccagattcggcgcaatgatatcgctggcaggcaaaccgtgccgcacatgaaactctgcgacacccggtgcaacgatacagcctttttccggatgacccattaccggatcgcaaaaatatttcgcctgcggattcgctgctttcacctgacgaacgataccgaggatatgttccccctgctccgccgaacccagatagccacttaatacggcatcacaggtgtgtaatttatcaatggcggcaatgccttgcacaatttcggttaaatggctgggcggcatcacgcagccagtccatttgccgtattgagtgtgattagaaaattgaacggtgttcagcggccagacgttcgcgcccaggcggcgcatcggaaactctgccgcactgttacccgcatgaccataaacaacgtgagactggatagcgagaatatttttcatcatgttccctgtataaaaaccagggggagtgatttctcactccccctttccacttaatgcattatttccagcaaatcagacagtaattctttttgccgcgacgcagtaaggtaaaacgaccaaacagacgatcttcttctttaaagaagtattcaggatcggactgtttttcaccgttaatggtgatggcattggaggcgatggttttacgcgcctgaccacgggaaggttgcagttcagaatcgaccagcgcctgcatcaggtctgcgcccttttccatctcaaccatcggtacgccgtcctgcgccagctgttcgaagtccgcttcactcagcgcactcaaggaaccgctgaacaggcattcggtaatacgttttgccgcctgtaaaccttcttcaccgtgaaccagacgagtcacctgctccgccagtacatactgggcgcgcggtgctttaccgctgtttttatcttcttcttccagggcgttgatctcttcaatgctcataaaggtgaagaacttcaggaagcggtaaacgtcggcatccgcagtgttgatccagaactggtagaatttgtacgggctggttttcttcggatccaaccagactgcgccgccttcagttttaccaaatttggtgccgtctgctttggtgatcagcggaacggtcaggccaaacacctgattctgatgcagacgacgggtcaggtcgataccagaagtgatgttaccccactggtcagaaccaccaatttgcagcaccacaccgtactgtttgttcagacaggcgaagtcataaccctgcaacaggttgtaggaaaactcagtgaacgaaatcccctgatcttcacggttgagacgctgcttaaccgcttctttgttgatcatctggttaacggagaagtgtttgccaatatcgcgcaggaaggtcagcacattcatattgccgaaccagtcatagttgttcgccgcgatagcagagttttctccacagtcgaaatcgaggaacggggcaacctgcttgcggattttgtccacccattcctgaacagtttcttcggtgttcagcttacgctcagcagctttgaagctcgggtcgccaatcagacccgtcgcgccgcctaccagcgcaaccggcttgtggcccgcctgctggaagcgtttcaggcataacaatggaacaagatgccccaaatgcaagctgtcagcggtaggatcgaagccgcaatagagcgcgatcgggccttgcgccagtcgctctgctaacgcttcctcgtccgtcacctgggctaccagcccccgctcttgcaattgtttaatcaagttactgcttgccatcaaaatctccatgtatataacgactgcacctttgccggtacacgacttttcgccagatgcgaaagagacatagaataaagtgccagaatcaggagtaccagcgattaaagcaagatttttgcatcttttcagggggcaagacgatcaatcttccacgcatcattttcacgctggtacaaaaagcggtcatgcaggcgatgctcaccgccctgccagaactcaatctgttcaaggctgacgcgaaaaccgccccaaaaactcggcaatggcacttcgccctgttgaaacttctgcttcagctccaggaatttactttcaaggataccgcgggcagaaatgcgactggactgcttcgaaacccatgcaccaatctggctatcacgcgggcggctatgaaaatatttcatcacttcgagagtcgaaagtcgttccgctttaccgatcaccatcacctggcgctcaagggtatgccacgggaacagcaggctaacgcgcggattattttcgatttgatgtgctttacggctgccgaggttggtgtaaaacaccatgcctttttcgtcgtaatgtttgagtaaaacgatgcgctgataaggctgaccatgttcatccacggtagcgaccaccatcgcggtagggtccgccagtttggcttcacacgcctgagagagccagcgttcaaaaagggttaatggatcggcgggaagatcgcggcggcgtaatccgcctttggtgtattcacggcgcagatgcgcgatttgctgcaattcgtcgttatcagacatggttttctttacggattgtcagtgggtgacgctattgtgcgccgcccctggaaaaatctcaacgctgtggattttgtaactgacagttattcaagacgatgcggtcgcgtttatagacagtcgcttcctcgcctttcgaccagaaaacatagatcccgtcggtgtaacgtgcaccagacgcagaaatgccctgtttgagatgcagtagttgattatcgtaaacaaaactgacttcctggcgcggattattcagtttgaccgtcaacggtttttcatcacactggtattccagcgtatcggtttgcatgcgctcaaccagttgattgaacgcgctacagccggtgagaaggaccggcaaacagatcagtaacagttttttcatagacatatcccgaagactttcctggtctggagggcaatacgccctccctaacgttccaagtgtaacggcagacgcggtaagaaaaattcagttaactctgatatcacgggttagcggggaaaatagccccgagtaccgtctcctggcttgcgccagtgacggaaggcagatttcctggtaatcccgccagcgtccgccaggcaagccaggcgaaagccaatgcttccatgtcatcgccactaatgccaacggcatcggtggtggtgacttctgtgcctggcagtaatgccgccagacgcgccatgagtagcggattacgacttcctccaccacataccatcaatcgttcgcagccaccgctcaacaaaacttgttcagaaatggtcacggcggtgagttctgccagtgtcgcctgtacatctcggggatcaacacccggaaaatggcgcaaatggcgctccagccagccgtagttaaagtattcgcgtccggtacttttcggtgcaggttgcgagaaatacgggtcgctaagcatattttgcagcagtgggagaatgactttacccgcccgtgcccactcggcatctttatcgtaaggtttacctgcctgacgccagatccaggcatccatcagcatgttaccaggaccggtatcgtagccccctaccggctgcccaggaatgagcagtgacagattggcgatgccaccaatattgagcaccattcgtcgctcggttgggtgagccagcagcgcatgatggaacgcaggtaccagcggtgcgccttgtcctcccaaggcaatatcgcgacggcgaaaatcaccgacaaccgtaattccggtgcgtgccacaatttgattgttatcgccaatctgtaaagtgtgtggtgccacgcccgtcggttcatgccagacggtttgaccgtgacagccgatcgcaacgatatctctcgcctgcaggttttgttccttaagcaaggcattgaccgcatcagcaaaaagtcgcccgagttgagtatcaagctgtccaaactgcgaaagtgtaagctgctggccctggcaaatatccagtacagcctgtttcagagacaccgggatcggccagctcaaacttgccagctgtgcgacccggtgttcatcaattgtcgccaacacaacatcaacaccatcaaggctggtgcctgacataacgccaataaagcggcccgatttcatagttcatcctttttcaatctgacgtttgcgcaccactcaaacataaacttttcgtgaataccatgcggaatgaccgatttttaccgttggtagtaaaacattatcttcaaatcaataatcatcatgaatgttttgtttataattggttgatcctactttcattatgatttgctcatatttggtagaacatgtaaccatggattcacatatgccatatactttgaccatgagggatgcttgcgtggcgtttcatggtgaacaggagatttttcaatgattaaacgcgtattggttgtttcaatggtaggtctgtctcttgtcggttgtgttaataacgacaccctgtcaggggatgtttataccgcttctgaagcgaaacaagtacagaatgtcagctatggcaccatcgttaacgtacgtccggtacagattcagggcggtgatgattccaacgttatcggcgcaattggcggtgctgttcttggtggtttccttgggaatactgttggtggcggaaccgggcgttctctggctactgcagcaggcgctgttgcaggtggcgtagccggtcagggcgtacagagtgcaatgaacaaaacgcagggtgtcgagctggaaattcgtaaagacgatggtaataccatcatggtggtacagaaacaaggcaacactcgtttctctccgggccaacgtgtcgtactggccagcaatggcagtcaggtgaccgtttccccgcgctaaataagtttgcgtgtggtcaggttactgaccacacgcccccttcatttcaccctttggcctgtaactcaatgatattatgctcaagttttgcgatgagcttaatcagttgttccagttcctctgcggagatgccatgtaaaatttccgcgcgggttttgttaataacagcttccatttcgctgatcagcggctctgccttttccgtcagtttaatacgtttagcccgacgatcgctggcacaagtttgacgcgaaattaaccctttttcttccagttggtccagagtacggaccagtgatggctgctcgatgccaatcgcttttgccagttgaatttgcgactggtctggaggtaactgatggatattgtgtaacgtaacccaatgggtttgtgttaactccagcggtttcaggcgatggtctatcagagcacgccatatgcgcaccaaccgtgccagatcagaacctagtggcgattccaatttcatctccttataattagcttgctaagatattatgcggcttttagaatagtgtgcagcaattgtattgctaaaacaaatgtattgctgcatttggttaccgtcagacatatttttcagaaattgcgcgtaaatttttcgcacttaaagaatatttattaatctaacgcaatatattcggtcgtaaaggaatctactttgtgaagtttatgctcaatgcaacaggattgcccttacaagatctggtgttcggtgcgtccgtctactttcctccgtttttcaaagccttcgcgtttggattcgtcatctggcttgtcgtacaccgcctgcttcgtggctggatctacgccggtgacatctggcatcccttgttaatggatttatcgctgtttgcgatttgcgtttgccttgccctggcaatactgattgcgtggtaactatgtcaattaaaacaattaagtatttctcaacaatcattgtagcggtagttgcggttcttgccggatggtggctgtggaattattacatgcaatctccgtggacacgcgacgggaaaatacgcgctgaacaggtttctatcacccctcaggtgtcgggacgtattgttgagctgaatataaaagacaaccaactggttaacgcgggggatcttctgctcacgatcgataaaacgccctttcagatcgccgagctgaacgcacaggctcagctggcgaaagcgcaatctgacctcgcaaaagccaataacgaagcgaatcgtcgtcgtcatctctcacaaaattttatttctgccgaagaactcgataccgctaacctcaatgttaaagcgatgcaggccagtgttgatgccgcacaggcgacgctgaaacaggcacaatggcaactggcgcaaacggaaattcgcgccccggtgagtggatgggtgactaacctcactacccgcatcggcgattacgctgacaccgggaaaccgctgtttgcccttgtcgacagccactcgttttacgtcattggttattttgaagaaaccaagttgcgccatatccgcgaaggtgcaccagcacaaattaccctctatagtgataacaaaacgttacagggtcacgtttccagtatcggtcgggcgatttatgatcagagcgttgaaagtgactcaagccttattccggatgtgaaacctaacgtcccctgggttcgacttgcccaacgcgttcccgtccgctttgcgctggataaagtcccaggcgatgtcacgctggtgtcgggcaccacctgtagcattgccgtaggtcaataatgaacgcatcgtcatggtccttgcgcaatttgccctggttcagggccacgctggcgcaatggcgttatgcgttacgcaataccattgccatgtgtctggcgctgacggttgcctattatttaaatctggatgaaccctattgggcgatgacctcggctgccgtggttagctttcccaccgttggcggtgtcatcagcaaaagcctcggacgcatcgctggcagtttgctcggagccattgcggcactgcttcttgccggacatacgctcaatgagccgtggttttttcttttgagcatggcggcgtggcttggcttttgtacctgggcctgtgcgcacttcacgaataatgtcgcgtatgcatttcaactggcgggctacacggctgccatcatcgcctttccgatggttaatattactgaggccagccagctgtgggatatcgctcaggcgcgcgtttgcgaggtgattgtcggtattttgtgcggcggcatgatgatgatgatcctgccgagcagttccgatgctactgcccttttaaccgcattgaaaaacatgcacgcccgattactggaacatgccagtttactctggcagcctgaaacaaccgatgccattcgtgcagcacatgagggggtgattggacagatactgaccatgaatttgctccgtatccaggctttctggagccactatcgttttcgccagcaaaacgcacgccttaatgcgctgctccaccagcaattacgtatgaccagtgtcatctccagcctgcgacgtatgttgctcaactggccctcaccgccatgtgccacacgagaaattctcgaacagctgctgacggcgctcgccagttcgcaaacagatgtttacaccgtcgcacgtattatcgccccgctacgcccgaccaacgtcgccgactaccggcacgtcgccttctggcagcgactacgttatttttgccgcctttatctgcaaagtagtcaggaattacatcgtctgcaaagcggtgtggatgatcataccagactcccacggacatccggcctggctcgtcataccgataacgccgaagctatgtggagcggactgcgtacattttgtacgttgatgatgattggcgcatggagtattgcttcgcaatgggatgccggtgccaatgcattaacgctggcagcaattagctgcgtactctactccgccgtcgcagcaccgtttaagtcgttgtcactactgatgcgcactctggtgttactttcgctattcagctttgtggtcaaatttggcctgatggtccagattagcgatctgtggcaatttttactgtttctctttccactgctggcgacaatgcagcttcttaaattgcagatgcccaaatttgccgcactgtgggggcaactgattgtttttatgggttcgtttatcgctgtcactaatcccccggtgtatgattttgctgattttcttaacgataatctggcaaaaatcgttggcgttgcgctggcgtggttagcgttcgccattttgcgtccagggtcgggtgctcgtaaaagccgtcgtcatattcgcgcgctgcgccgggattttgtcgatcagctaagccgccatccaacactgagtgaaagcgaatttgaatcgctcacttatcatcacgtcagtcagttgagtaacagccaggatgcgctggctcgccgttggttattacgctggggtgtagtgctgctgaactgttctcatgttgtctggcaattacgcgactgggaatcgcgttccgatccgttatcacgagtacgggataactgtatttcactgttgcgcggagtgatgagtgagcgtggcgttcagcaaaaatcactggcggccacacttgaagaattacagcggatttgcgacagccttgcccgccatcatcaacctgccgcccgcgagctggcggcaattgtctggcggctgtactgctcgctttcgcaacttgagcaagcaccaccgcaaggtacgctggcctcttaattacttaatcacaccacaggcatagcgttcaccgccaccgcccagcggtttaggttgatcggacatattatcgccgccaacgtggaccatcagcgctttgtctttgatttcatccagtgatttcagacgaggcgcgatgacggcatcggtagctttgccgtcattattgacgaccagtgcaggcagatcgcctaaatgcccggcaccttctgggccttcatgtttaccggtattttgtggatcaagatgcccgcctgcggattccgcggcgctggctttgccatctttggtggctggctggcagcttcctttggcatgaatatggaagccatgttcaccggggggtaatgctttcaggtcgggcgaaaactccagacctttatcggtttcagtaatggtgacgctaccaattgactgcccaaccccttgcgacgtgacgaggttcatctcgactttttcactggcagcttgtgcgccggtcgcaacaaccagcgccagaatggccagactaaaacgtttcataggacctccgttcattgtgcattcctgaataagtgtaaaccagtgacacatttttgaacggcggctattcctaaaagtgcttacggtacgtcgtaacccagtgccgctttacggatacgaaaccattgttgacgggtcattttcagtgtttctgcttcgacagctgcccgtacgcgctcaattttacctgagccgataattggcagcggctgcgacggtaaacgtaatacccaggcgtaaaccacctgttcaatcgagcccgcgtttaactcctctgccaccacagccagttcatcacgcagcggctggaaataatcatcattaaacagacgaccaccaccaaggcaggaccacgccatcggacgaacacgcagttgttgcagttggtcgagcgtaccatccagcagtaacggctgatgtaccggggatatttccacctgattagtggcaagggtaaacggcaggcgtgattgcaaaagcgcaaattgcgcaggcgtaaagttcgatacgccaaaatggcgcactttgccgctctgatgcagatgtttaaacgcgtccgccacttcatcggcatccattaacgggtctggtcggtggattaacagcagatccagatgatcggtcgcgagattaattagcgactgttcggcgctcttaatgatgtgatcgcggtcagtgatgtaatgaccaatgacgttttcttcacgcgtggtcgtcgcgataccgcatttactgacgatttccatccgttcacgcagatgaggtgcaagtttcagcgcctcgccaaacgccgcttcgcactgatagccaccataaatatcagcatggtccacggtggtcacgccgagatccagatgctcttcaataaaactgaccagctggcgggcggacatattccagtccatcaatcgccagtagcccatcacaaaacgggaaaactccgggccttgcggcgcaatagtaatacgctgaaccataatcgcttcctcttatcagatatgagaggagtatacgcaagattaggctcaaaagagtgatggttgctccggttcgtctgatgacgctggcttatttgcgcgtaatttgcgcattaatcgctgccgacaaaggcgcagcacctcttgtttttcgccatcgctcattttattccagttaaaacgctcatcccgactacgaaaacagccgcgacaaaacccgcgttcgtcagactggcaaattccccggcacgggctctggacgggaaagaactctaattgctccgccacttcgccctcctcaaaataagattattaccattattgaagctgttaatgcccaaagtagcaactttgcttgcactagaccgactggtctactacactccaacgcatgaacaaacacaccgaacatgatactcgcgaacatctcctggcaacgggcgagcaactttgcctgcaacgtggattcaccgggatggggctaagcgaattactaaaaaccgctgaagtgccgaaagggtccttctatcactactttcgctctaaagaagcgtttggcgttgccatgcttgagcgccattacgccgcatatcaccagcgactgactgagttgctgcaatccggcgaaggtaactaccgcgaccgcatactggcttattaccagcaaacactgaaccagttttgccaacatggaaccatcagtggttgcctgacagtaaaactctctgccgaagtgtgcgatctgtcagaagatatgcgtagcgcgatggataaaggcgctcgcggcgtgatcgttctgctctcgcaggcgctggaaaatggccgtgatagccattgtttaaccttttgtggcgaaccgctgcaacaggcacaagtgctttacgcactatggctgggtgcgaatctgcaggccaaaatttcgcgcaattccgagccactggaaaacgcgctggcacatgtaaaaaccattattgcgacgcctgccgtttagcaggcattttttatcaccagacgaccgggagcctttatgtcatctgaaaaactgtattccccactgaaagtgggcgcgatcacggcggcaaaccgtatttttatggcaccgctgacgcgtctgcgcagtattgaaccgggtgacatccctaccccgttgatggcggaatactatcgccaacgtgccagtgccggtttgattattagcgaagccacgcaaatttctgcccaggcaaaagggtatgctggtgcacctggcatccatagtccggaacaaattgccgcatggaaaaaaattaccgctggcgttcatgctgaaaatggtcatatggccgtacagctgtggcacaccggacgcatttctcacgccagcctgcaacctggcggtcaggcaccggtagcgccttccgcacttagcgcgggaacacgtacttctctgcgcgatgaaaatggtcaggcgatccgtgttgaaacatccatgccgcgtgcgcttgaactggaagagattccgggtatcgtcaatgatttccgtcaggccattgctaacgcgcgtgaagccggttttgatctggtagagctccactctgctcatggttatttgctgcatcagttcctttctccttcttcaaaccatcgtaccgatcagtacggcggcagcgtggaaaatcgcgcacgtctggtgctggaagtggtcgatgcagggattgaagaatggggtgccgatcgcattggcattcgcgtttcgccaatcggtactttccagaacacagataacggcccgaatgaagaagccgatgcactgtatctgattgaacaactgggtaaacgcggcattgcttatctgcatatgtcagaaccagattgggcggggggtgaaccgtatactgatgcgttccgcgaaaaagtacgcgcccgtttccacggtccgattatcggcgcaggtgcatacacggtagaaaaagccgaaacgctgatcggcaaagggttaattgatgcggtggcatttggtcgtgactggattgcgaacccggatctggtcgcccgcttgcaacgcaaagctgagcttaacccacagcgtgccgaaagtttctatggaggcggtgcggaaggctacacggattacccgacgctgtaatccaacattgcgagcggcgtaaagccgccgctatactaaaacaacattttgaatctgttagccattttgaggatataaagatgcgtcttcttcataccatgctgcgcgttggcgatttgcaacgctccatcgatttttataccaaagtgctgggcatgaaactgctgcgtaccagcgaaaacccggaatacaaatactcactggcgtttgttggctacggcccggaaaccgaagaagcggtgattgaactgacctacaactggggcgtggataaatacgaactcggcactgcttatggtcacatcgcgcttagcgttgataacgccgctgaagcgtgcgaaaaaatccgtcaaaacgggggtaacgtcacccgtgaagcgggtccggtaaaaggcggtactacggttatcgcgtttgtggaagatccggacggttacaaaattgaattaatcgaagagaaagacgccggtcgcggtctgggcaactaatctcctgccgggcgtgaactcatcgcgcccgcatctttactgcatcgacaagtaatatttgtcataatgcgcgctgcaatttatccgtattaagagaatcagatgtccgataacgctcaacttaccggtctgtgcgaccgttttcgtggtttttatcctgttgtgatcgatgttgaaacagccggatttaacgccaaaaccgatgcgctgcttgagattgccgccatcaccctgaaaatggatgaacaaggctggctgatgccggacaccacattacatttccacgtcgaaccatttgtcggcgcaaatttgcagccagaggccctcgccttcaacggcattgacccgaacgatcccgatcgcggcgcggtcagcgaatacgaggcgctgcacgaaatttttaaagttgtgcgtaaaggtattaaagcgagcggttgtaaccgcgccattatggtggcgcacaacgccaatttcgatcacagctttatgatggccgccgcagaacgcgcctcactgaaacgtaacccgttccaccctttcgccacttttgacactgctgcactggccgggctggcactcggacaaaccgtattgtcaaaggcttgccagaccgctggcatggacttcgacagcacccaggcgcactccgcgctgtacgacaccgaacgcactgctgtgctgttttgtgaaatcgtcaaccgctggaaacgtctgggaggttggccgctacctgccgccgaagaagtgtaatcgagtcgatgcctgatgacatgcaatgattcaggcatctatagtgaggctattccacgcatcatgcatgatattcacggggaatagcgttaatggcagataatccaaacctttcatcgcccctgccggacgtgttttcaccggcaacccgcgactggtttcttcgcgcctttaaacagccgaccgctgtccagtcgcaaacctggcatgtggcggcgcgaggcgaacatgcgctggtgattgcaccgactggctccgggaaaacgctggcagcatttctctacgccctcgatcagctcttccgcgaaggcggcgaagatacccgcgaggcgcataaacgtaaaacctcacgcatcctctatatttcaccgataaaagcccttggcaccgacgttcagcgcaacttgcagatcccgttacagggtattgccgatgaacggcggcggcgcggcgaaacggaagtcaatcttcgcgtggggatccgtactggcgatacgcctgcacaggaacgcagcaaactcacccgtaatccgccggatattctgatcaccacacccgaatcactctatctgatgctgacctcccgcgcgcgcgaaacgctacgcggcgtcgaaacggtaattattgatgaagtccacgcggtagcaggcagtaaacgtggtgcgcatctggcgttaagtctggagcggctcgatgcgctgctccacacctcagcacagcgaattggcctttctgccactgtgcgttcagccagcgatgtggcagcatttcttggcggcgatcgcccggttacggtagtcaacccgcccgcaatgcgccatccgcagatacggattgtcgtaccggtcgccaatatggatgatgtctcatcggtcgccagcggcactggcgaagacagccatgctggccgggaaggctccatctggccatatattgaaacgggtatccttgatgaagtgttgcgccatcgctcgaccattgtctttactaattcgcggggactggcggaaaaactgacggcacgattaaatgagctttacgccgcacgcttacagcgttccccgtctatcgccgttgatgcggcccatttcgagtcgacctccggcgcaacctctaaccgtgtacaaagtagcgacatttttattgcccgctcacaccacggctccgtctctaaagaacaacgagcaatcaccgaacaggcgctgaaatcgggtgaattacgctgtgtggtcgcaacctccagtctcgaactggggattgatatgggcgcggtggatctggtgattcaggtggcaacgccgctttctgttgccagtgggttacaacgcattggacgtgccggacaccaggtaggaggtatctccaaagggctgtttttcccccgaacccggcgtgacttagtcgattccgcagtcattgtagagtgtatgttcgcaggcaggctggaaaacctgacaccaccgcataatccactcgacgtccttgcgcagcaaaccgttgccgccgcggcgatggatgcattacaggtagacgaatggtactcccgcgtacgccgtgccgcaccgtggaaagatctgccaagacgtgtttttgacgccacgctggatatgctttccgggcgctatccctctggcgatttttctgcttttcgccccaaactggtctggaaccgggagaccgggatattgaccgcccgacctggcgctcagctgttggcggttaccagcggtggcaccattccggatcgtggcatgtatagcgtgttattacccgaaggtgaagaacaggccggttcgcggcgggtgggtgaactggatgaggagatggtatatgagtcgcgggtgaacgacattatcactctcggcgctacctcatggcggatccagcaaatcacccgcgatcaggtgattgtgactcctgctccgggtcgttctgcccggctccccttctggcgtggtgaaggtaacggacgtccggcagaattaggcgagatgatcggcgattttctccatttactggcggatggcgcgttcttttccgggactattcccccgtggttggcagaagaaaatacgatcgccaatattcaggggttgattgacgagcagcgcaacgcgacgggcatcgttccggggagtcgtcatctggtcctcgaacggtgccgtgatgaaattggtgactggcgtattattttgcactctccctatggaagacgggtgcatgaaccctgggcgctggcgattgccgggcgaatacatgcactatggggcgctgacgcgtctgtggttgccagtgatgacggcattgttgcgcgcattcctgacaccgatggtaaattgcccgatgccgcgatttttttgtttgaaccagaaaagttgctgcaaattgtccgcgaggcggtaggcagctcggcacttttcgccgcccgttttcgcgaatgcgccgcgcgggcattattaatgccgggccgcacgccgggccatcgcaccccgctctggcaacaacggctgcgcgccagtcagttgctggaaatcgctcagggatatccagattttccggtcattctcgaaaccctacgcgaatgtctgcaagatgtttatgatcttcccgcgctggaacgtttgatgcgtcgcctgaacggtggcgaaattcaaatatccgatgtaacgaccactacgccttcgcctttcgctgccagtttattgttcggctatgtcgcggaatttatgtaccagagcgacgccccgctggcagagcgccgggcatccgtactgtcgctggacagcgagttactgcgcaatctactcggacaggtcgatccgggggaattactcgacccacaggtcattcgccaggtggaagaagagttgcaacgactggctcctggcagaagagcgaaaggtgaagaaggattgttcgacctgctgcgcgaactggggccaatgaccgttgaagacctggcgcaacggcatacaggcagcagtggagagattgcgtcgtatctggaaaatcttcttgcagtaaaacgaatcttcccgacgatgattagcgggcaggagcgtcttgcctgtatggatgatgccgccaggctgcgcgatgccctcggcgtacgactaccagagtcactgccagagatttatttgcaccgagtcagttacccgcttcgcgacctctttctgcgctatctccgggctcatgctctggtcacgtctgaacaactggctcatgagtttagtctcggtattgccattgtcgaagagcaacttcagcaactgcgcgaacaggggctggtgatgaatctgcaacaagacatctgggtgagcgatgaagtatttcgtcgtctgcgtttgcgctcgctgcaagccgccagagaagcgacacgtcccgttgcggccacgacctatgcgcgattgctgctggaacgtcagggcgtattacccgccaccgatggtagcccggcactctttgcctcaacatcaccaggcgtttatgagggcgtggatggcgtcatgcgggtgatcgaacagcttgccggagtcggtttacccgcctcactctgggaaagccagatcctgcctgcccgcgtacgcgactattcgccagaaatgctcgatgaattactggcaaccggtgcggttatctggtcggggcaaaaaaagctgggtgaagatgacggtctggtggcactgcatctacaggaatatgccgcagaatcgttcacttccgccgaagcggatcaggcgaatcgttcggcgctgcagcaagcgataatcgctgttctggctgacggaggagcctggtttgcacaacaaatcagccaacggatacgcgataaaatcggcgaatcggttgatccctcggcactgcaagaggcgttatgggcgctggtctggcaaggcgtcatcaccagcgatatttgggcaccgttacgcgctctcacccgcagcagttccaacgcacgcacctcaactcgccgcagtcaccgggctcgtcgtgggcgtcctgtctatgcacaacccgtctcgccgcgggtatcttacaacacaccaaatcttgctggacgctggtcgttattgcaggtggagccactaaacgataccgaaaggatgctggcgctggcggaaaatatgctcgaccgctacggcatcatcagtcgtcaggcggtgatagccgaaaatatccctggcgggtttccatcgatgcaaacgctttgtcgaagtatggaagactccgggcgaattatgcgaggtcgttttgtagaaggtctggggggtgcgcaattcgctgaacgtctgactattgaccgattgcgcgatctggcgacacaagccacgcaaacgcgccactatacaccagtggcgctctccgccaacgatccggctaatgtgtggggaaatcttctgccctggcctgcacatccggcaacgctggttccaacgcgtcgggcgggtgcgctggtggtcgtttctggcggcaaattgttactctatctggcgcaaggcggcaaaaaaatgctggtctggcaggaaaaagatgaattactcgccccagagattttccaggcgctgaccaccgcactgcgtcgcgaaccacggctgcgctttacgctaacagaagtgaatgatctaccggtccggcaaacgccgatgtttacgctgctgcgtgaggcgggattttcaagttcgccacaagggctggattggggatagataaagaactgacggatgcccgttcgcatccgtcagtactgcaggacggattattccgcgtccggctcttcagacttgtatttagcggcagtttctttgatcagctgctgcagttcgccacgctgatacatttcgatcacgatatcacaaccgccgaccagctcgccgtcaacccacagttgcgggaaggtcggccagttagcatatttcggcagttccgcacgaatgtccggattctgcagaatatcaacataggcaaaacgttcgccacatgcggcaagcgcctggactgcctgggcagagaaaccgcagctcggcagtttcggtgaacctttcatgtacagcaggatcgggttttcagcaatctggcgttggattttttcgatagtggtgctcattgtcttgcttcctcaaacttctttacggcagtaatctgacattgtagcgggtcagtgcggcatcggaaaataacattttcatcacgcttttgctattttatccctttgctctatttgttgcatttcaaatattcgtttcttccctgacgcaaggcaaactggcgtatttatgaccatttttagctttcactgctgcatttttttgcgctcgccgacgaaacgtattttttaacaataaaagctattaactttctcttcttctatgcattagaatcatcaagttttgtaaatcagacgcaggcatgatagacctgccttaacagagggacgctcagtggcgcggataaaccgtatttcgatcacgctctgtgctttactttttaccaccctgcctttaacgcctatggcccatgcttcaaagcaagccagggagagttctgctactactcatatcaccaaaaaagcagataaaaagaaaagcacggcaaccaccaaaaagacccagaaagccagccagaaaacagcgaaaaaagccgccagtaaaagtacgatcaaaagcaaaaccgcttcttccgttaaaaaatcttccattaccgcttctaaaaacgccaaaactcgcagcaaacacgccgtcaataaaacggcctcagccagctttaccgaaaagtgtaccaaacgtaagggctataaatcgcattgtgtgaaagtcaaaaatgccgcgtcaggaactcttgccgacgcgcacaaagcgaaggtgcaaaaagccacgaaagtggcaatgaataaactgatgcagcaaattggtaagccatatcgttggggtggcagctcaccgcgtaccggttttgattgcagcggcctggtttattacgcttataaagatttggtgaaaattcgtattccgcgtacggcgaatgaaatgtatcacctgcgcgatgcagcgccaatcgaacgtagtgaactgaaaaacggcgacctggtctttttccgtactcagggacgcggtacagccgatcatgtcggcgtgtatgtcggcaacggcaaatttattcagtcaccgcgcacgggtcaggaaattcaaatcacttctctcagtgaagactactggcagcgccactatgttggcgctcgtcgggtaatgaccccaaaaacacttcgctaaaactttaccctgttgttacggcaacagggtaagttcatcttttgtctcaccttttaatttgctaccctatccatacgcacaataaggctattgtacgtatgcaaattaataataaaggagagtagcaatgtcattcgaattacctgcactaccatatgctaaagatgctctggcaccgcacatttctgcggaaaccatcgagtatcactacggcaagcatcatcagacttatgtcactaacctgaacaacctgatcaaaggtaccgcgtttgaaggtaaatcactggaagagattattcgcagctctgaaggtggtgtattcaacaacgcagctcaggtctggaaccatactttctactggaactgcctggcaccgaacgcgggtggcgaaccgactggaaaagtcgctgaagctatcgccgcatcttttggcagctttgccgatttcaaagctcagtttactgatgcagcgatcaaaaactttggttctggctggacctggctggtgaaaaacagcgatggcaaactggctatcgtttcaacctctaacgcgggtactccactgaccaccgatgcaactccgctgctgaccgttgatgtctgggaacacgcttattacatcgactatcgcaatgcacgtcctggctatctggagcacttctgggcgctggtgaactgggaattcgtagcgaaaaatctcgctgcataataactgatggcaaatgcaacattgcctgatgcgcttcgcttaccataccaactcggatgaagcgttaacactgcatccggcaagataaatcgcacgttgccagcaactgtaacgcagaaggttatccttctgcgtttttatttaattagctgttggcaacgcaaactgtttcaggttgttttctggctgacataaacaccagcaataatgccagtcccgcgacaatcgcccccatcaccggcacaaaactgtatcccagcccagcggaaattaccgcaccaccagcagctgctcccagagcatttccaagattaaaggcaccaatattgactgatgaagacagacctggcgcttcactggcgacacgcatcacgcgcatctgtaacggcggtacgaccgcaaaggttgcagctccccacaccaccatgctaatagctgcgccgaactcattgcgggccaggaacgggattgccagcataatcaccatcagcagcaacaaaaagcctttcaacgtgccgttaactgaacgatctgccagtttgccgccgagatagttaccgatagagaatccgacaccaatcagcaccagcattgccgtgacgaacaccggcgttgcgtgggtaatgctttgcagtaccggagagatataggtgtagagggtaaacattgcaccagctcccagtaccgtcgtcagcaatgcagacagcacctgcggacgcattaataccgccagctcttttttcacttcaggtcgcgcccctgcgccacctttaggtaatgagaagaacagacttaccattgaaatcacgcccagccccgccgttgccagaaatgacatccgccagccgatggtttcgcccaaccaggtcgctgccggaacgccaccgatatttgccagggttaaccccataaacatagtggcaactgcgctggcctgtttatgttttggcaccacgcttgcggccacaactgaacccaaaccaaaaaatgctccgtgattcaggctggtcaaaatgcgtgaaagcatgagagtcatataatccggcgcgatggcggaaagtacgttgccgagcgtgaaaatcgccatcaggaaaatcaacgcactgcggcgggcacgatgagaaagtagaagcgtcatcagcggcgcgcccaccattacgccaactgcataggcactgattaacattccggcagcgggaatcgagacatccacaccgcgcgcaatgacgggcaataagcccattggcgagaactccgttgtcccgataccaaacgcgccaatcgccagcgccagcaacggatagttaattttcatgccttatctccacctcttcgcgtcattacgcgatattcattaaagtggcgaaagcatgacagcaatcacaaaaaaatgaaaataacaaaaagagaaaacacttttgccattttgctaacaaacaggaaggagatgcgagggagaacgcgctccctcgagaggaaatcagtgcagcgcggcagtcaaacccacggccacgatcaaaccgaggacgataatcgttgttaccagtgaaaatttaaggtcggtgctcatcaagttttctccttttttattaccacacaaaaagtgatattacgcatttttacacactgtgatgaaaaaatctcccgtcatttataatgataagtgtttttaccacttccccttttcgtcaagatcggccaaaattccacgcttacactatttgcgtactggccattgaccccttcctgacgctccgtgtcgtttttccggcgtaccgcaacacttttgttgtgcgtaaggtgtgtaaaggcaaacgtttaccttgcgattttgcaggagctgaagttagggtctggagtgaaatggaatggcaacaataaaagatgtagcgaaacgagcaaacgtttccactacaactgtgtcacacgtgatcaacaaaacacgtttcgtcgctgaagaaacgcgcaacgccgtgtgggcagcgatcaaagaattacactactcccctagcgcggtggcgcgtagtctgaaggttaaccacaccaagtctatcggtttgctggcgaccagcagcgaagcggcctattttgccgagatcattgaagcggttgaaaaaaattgcttccagaaaggttacaccctgattctgggcaatgcgtggaacaatcttgagaaacagcgggcttatctgtcgatgatggcgcaaaaacgcgtcgatggtctgctggtgatgtgttctgagtacccagagccgttgctggcgatgctggaagagtatcgccatatcccaatggtggtgatggactggggtgaagcaaaagctgacttcaccgatgcggtcattgataacgcgttcgaaggcggctacatggccgggcgttatctgattgaacgcggtcaccgcgaaatcggcgttatccctggcccgctggaacgtaacaccggcgcaggccgccttgccggttttatgaaggcgatggaagaagcgatgatcaaggtgccggaaagctggattgtgcagggtgactttgaacccgaatctggttatcgcgccatgcagcaaatcctgtcgcagccgcatcgccctactgccgtcttctgtggtggcgatatcatggcaatgggcgcactttgtgctgctgatgaaatgggtctgcgtgtcccgcaggatgtttcgctgatcgggtatgataacgtgcgcaacgcccgctattttacgccggcgctgaccacgatccatcagccaaaagattcgctgggcgaaacggcgttcaacatgctgttggatcgtatcgtcaataaacgcgaagaaccgcaatccattgaagtgcatccgcggttgattgaacgccgctccgtggctgacggcccgttccgcgactatcgtcgttaatcacccgttgcgggagtctcttccggctcccgcagccactccttattcagcgtctcactatcgccgagatactcaagcaaccaggttaacgcaggcgacatatcattttgctgccatgtcagacaacatgccgaatccgggaaggggttttccagttctagtgctacccacttaccctcattaagccacggtttggcgaaatgtgttggcaccatccctatgcataatcctgccgagatacaggttgccgatgattcccagtcaggcacgacaagtcttttttggttatccagcaaccaggtaatacgtttaggtagcgttcgcgaggtgtcttcgcgcaccaacgacggccagttgcgcaacgtatcatcgctgaacgggccatccatcaacgccagcgggtggtgactggcaacaacgcaactccagcttagcatccccatatcccggaaggcataacgaccgcctaccggaatcgcgcgtgttgcgccaatcgccagttccacgcgcccgtcggaaagcgcatcccagacaccgttgaacacttcctgaaagacaagaagttcgacatcatcaaaatggcgataaaaatcaacgatcatctgccgtgtacgttctggcctgacaatattatccactgcgatagctaactgaccgcgccagccgttcgctatctgctgacattgctgccgggtgatctgcatttttttgacaacagagcgcccttctttgagaaaccacgccccggcagcggtcagttccacatcacggtgacgtcgttcaaacagcggcaccgccagccactcttccagctgacgcacggtatagctgaccgcagaaggaacgcgatgcaactcctgtgccgcagcgctaaaactaccattacgcgctaccgcatcaacaacttcgagtgaatattctgaccacatagtctgcctgcaaaatttttgaaaccagtcatcaaatattaccgtttcacaacactaatttcactccctacactttgcggcggtgtttaattgagagatttagagaatatacatgcaacctgggaaaagatttttagtctggctggcgggtttgagcgtactcggttttctggcaaccgatatgtatctgcctgctttcgccgccatacaggccgacctgcaaacgcctgcgtctgctgtcagtgccagccttagtctgttccttgccggttttgccgcagcccagcttctgtgggggccgctctccgaccgttatggtcgtaaaccggtattattaatcggcctgacaatttttgcgttaggtagtctggggatgctgtgggtagaaaacgccgctacgctgctggtattgcgttttgtacaggctgtgggtgtctgcgccgcggcggttatctggcaagcgttagtgacggattattatccttcacagaaagttaaccgtatttttgcgaccatcatgccgctggtgggtctatctccggcactggctcctctgttaggaagctggctgctggtccatttttcctggcaggcgattttcgccaccctgtttgccattaccgtggtgctgattctgcctattttctggctcaaacccacgacgaaggcccgtaacaatagtcaggatggtctgacctttaccgacctgctacgttctaaaacctatcgcggcaacgtgctgatatatgcggcctgttcagccagtttttttgcatggctgaccggctcaccgttcatccttagtgaaatgggctacagcccggcagttattggtttaagttatgtcccgcaaactatcgcgtttctgattggtggttatggctgtcgcgccgcactgcagaaatggcaaggcaagcagttattaccgtggttgctggtactgtttgctgtcagcgtcattgcgacctgggctgcgggcttcattagccatgtgtcgctagtcgaaatcctgatcccattctgtgtgatggcgattgccaatggcgcgatctacccgattgttgtcgcccaggcgctgcgtcccttcccacatgcaactggtcgcgccgcagcgttgcagaacactctacaactgggtctgtgcttcctcgcaagtctggtagtttcctggcttatcagtatcagcacgccattgctcaccaccaccagcgtgatgttatcaacagtagtgctggttgctctgggttacatgatgcaacgttgtgaagaagtagactgccagaatcatggcaatgccgaagtcgctcatagcgaatcacactgatctatatcgatatgcttatacttaggctgctaacaaaattttgttgtatgattgaaattagcggcctatactaatttcgagttgttaaagctacgataaatattatgtttttacggggacaggatcgttcccgactcgctatggatggtcatttcggcaagggttcctcctttccctctgttctacgtcggattatagactcgcggttttttctgcgagatttctcacaaagcccaaaaagcgtctacgctgttttaaggttctgatcaccgaccagtgatggagaaactatgagttcatcgtgtatagaagaagtcagtgtaccggatgacaactggtaccgtatcgccaacgaattacttagccgtgccggtatagccattaacggttctgccccggcggatattcatgtgaaaaaccccgatttttttaaacgcgttctgcaggaaggatcgttggggttaggcgaaagttatatggatggctggtgggaatgtgaccgactggatatgttttttagcaaagtcttacgcgcaggtctcgagaaccaactcccccatcatttcaaagacacgctgcgtattgccggcgctcgtctcttcaatctgcagagtaaaaaacgtgcctggatagtcggcaaagagcattacgatttgggtaatgacttgttcagccgcatgcttgatcccttcatgcaatattcctgcgcttactggaaagatgccgataatctggaatctgcccagcaggcgaagctcaaaatgatttgtgaaaaattgcagttaaaaccagggatgcgcgtactggatattggctgcggctggggcggactggcgcactacatggcatctaattatgacgtaagcgtggttggcgtcaccatttctgccgaacagcaaaaaatggctcaggaacgctgcgaaggcctggatgtcaccattttgctgcaagattatcgtgacctgaacgaccagtttgatcgtattgtttctgtggggatgttcgagcacgtcggaccgaaaaattacgatacctattttgcggtggtggatcgtaatttgaaaccggaaggcatattcctgctccatactatcggttcgaaaaaaaccgatctgaatgttgatccctggattaataaatatatttttccgaacggttgcctgccctctgtacgccagattgctcagtccagcgaaccccactttgtgatggaagactggcataacttcggtgctgattacgatactacgttgatggcgtggtatgaacgattcctcgccgcatggccagaaattgcggataactacagtgaacgctttaaacggatgtttacctattatctgaatgcctgtgcgggtgctttccgcgcccgtgatattcagctctggcaggtcgtgttctcacgcggtgttgaaaacggccttcgagtggctcgctaaaggctattctatcgccccctctccgggggcgatttcagatcaggcttctgtacctggttgattcatggcattttctcgtgccgccagcactcgttctaccgtatctaccactgcctgagtttgtggatcgatttcaatgttgacgcgtgcgccaagttttttcttcccaagagtcgtgcgttccagtgtttccggaattaaatggacgcaaaaacgcgttggcgtgacttcaccgacggtcaggctaataccgtcgatgccaataaatcctttgtacagaatatatttcatcaactgactatcctggactttaaaccagatctggcgattattttccgaggttaatattttcgccacttcagcggtggtcataatatgacctgacattaagtgtccgccaatttcatcactgaatttcgccgcacgctcaacgtttacccaatcccccacttttaaatcgccaagattggtaatgcgtaacgtttctttcatcaggtcaaaactgacatggttgccgttaatttccgtcacggtcaggcagcaaccgttatgcgccacggaagcaccggtttccagaccgtccagcatgtggtcgggtaactccaccacatgtgtgcgaaaatttggtttctcgtcaatcgacaccagttttgcggtgccctgtacaatccccgtaaacatacttacaactcctgaaatcagttaagacattctgttcagcacaatagcaggtggaaaacgcccttaccagtgaaggggtaagaatgactattttttcactggagaattaataaatcctcgctacaatagactgaatttcccctgcttcttctttttgctgcccattcaggcggctttttagtctctcatataactacaaataaaaggtgttcacgtgcagaagtatatcagtgaagcgcgtctgttattagcattagcaatcccggtgattctcgcgcaaatcgcccaaactgcgatgggttttgtcgataccgtgatggcgggcggctatagtgccaccgacatggcggcggtcgctatcggtacttctatctggcttccggcgatcctctttggtcacggactgctgctggcattaacgccggttatcgcgcaattaaatggttccggtcgacgtgagcgcattgcgcatcaggtgcgacaaggtttctggctggcgggttttgtttccgttctcattatgctggtgctgtggaatgcaggttacattatccgctccatggaaaacatcgatccggctctggcggacaaagccgtgggttatctgcgtgcgttgttgtggggcgcgccgggctatctgttcttccaggttgcccgtaaccaatgtgaaggtctggcaaaaaccaagccgggtatggtaatgggctttatcggcctgctggtgaacattccggtgaactatatctttatttatggtcatttcggtatgcctgagctcggtggcgttggttgtggcgtggctactgcggcggtgtattgggtcatgttccttgccatggtttcttacattaaacgcgcccgctccatgcgcgatattcgtaacgaaaaaggcaccgcgaagcccgatcctgcggttatgaaacgactgattcaactcggtttgccaattgcgctggcgctgttctttgaagtaacgctgtttgccgtcgtggctctgttagtgtctccgctcggtattgttgatgtcgcaggacatcagattgccctgaactttagttcactgatgtttgtgcttccaatgtcgctggcggcagcggtaactatccgcgtaggttatcgtctgggtcagggctcaacgctggatgcgcaaaccgctgcgcggaccgggcttatggtgggtgtctgtatggcaaccctgacggccattttcacggtttcactgcgggagcaaatcgccctgttgtacaacgacaatcccgaggttgtaacgctggctgcgcatttgatgttgctggcggcggtatatcagatttctgactctatccaggtgattggcagtgggattttgcgtggttataaagatacgcgttccattttctatatcacctttacggcttactgggtgctgggcttgccaagcggctatattctggcactgaccgatctggtcgttgaacctatggggccagcaggcttctggataggctttattattggcctgacgtcggcagccattatgatgatgctgcgtatgcggttcctgcaacgtctgccgtcagccatcattctgcaacgagcagctcgctagtaaagacaaggcgcaaacttcacgggttgcgcctgtgtttttacgcaggctggagcgttgcgccaatcccgtcttcgtctggctgtagtttcagtgcgttacacagagtttgccgactggcatctgttatctcaacgtgtatatcaccagtaacttcccctttcacattgatgaagtcaggtgaaatttctttcgcactggtttgcaggcaaatggctccctctccacgcaggcgtttcactttcagttgcacatgcgttgccgcaccagtgattagccacagttttccgccatttagattgatgttaccaacattgaaagtgacactgtcaccttttaccatactgccgtcgagaatcaatacaccgccctgctgtacagtaatcgttgattgttgcagatctgcgccatagccaataatcattgaagcgccgtccagtaatgcaacactaccggtcagttcaaccggtgcgcgatcttcctctacgacaaaattttcgtccgcgctggtgggtgacaacaggatgactgtcccaccttgtattaccgcattttccagcgtaccggcatgcacttcagcccgaccacccacattaacggacaggttttgcgtcttaccggaactgtagagctgaagaccatccgtccccagacgataagtggatccattctcaacaatagtgtcagagtcttcaccaccgagattattcatggtgccaccagcaagcaatgtatcactggctttccccgccagcataaaaacgccgccctgattaatctcacaattgctggcttccccacctggatacaccaacaattcaccaccttcatctaccacgaccgctgaggttgtcccattgaccaacaggccaccctcttgatcgagaataattttttccgcgcgatggccttccagtacacgcaggttaccgccattttccagcaacaaaccgcaggcataacctttatcaacgctgaattcaccttcgggatggcggccattaaccgtagcgagcgtagagagactaattgcgcctccctcggactgaacaatatctgtggcaatggcaccgtcgctgaccgatagcgtgccattgttgccgtactgtgtgcatttggcgatcccaccggttgccactttcaaccagccagcccccgtgaccacggtattttcggctcttccgccagcttcaacaattaactcaccttcagtaagttgcgtcgcgccaatgacctcgccggtcttaacaatttgcacgttcccgtcgctcatcaagtttttcgcatcagatcccatgatttattcctttgctgcatctgtgtgcctttattgctacctaagtgtaaaggctacggaggatttatccacgacagattttgagatggtggcaaacaactctgtttaaactctgatacacggattattgggttgtatctgatgtaaatgcgatcctgaataaaaatcgcccttgcaaatcaacaaaatatagccaatttgcttaaaagctctgcaaacggtcgaaatagcgcagaaaattacgttttgcctcttgccaccttcccactctgccgctaatattcgtccccgttgtcacctacaacgttgcgttcatagctcagttggttagagcaccaccttgacatggtgggggtcgttggttcgagtccaattgaacgcaccatcctgcgtccgtagctcagttggttagagcaccaccttgacatggtgggggtcggtggttcgagtccactcggacgcaccagattttcttaatctggtcttctcctttttccctctgtttcttctctgtatccaatacgttaaaagatttacactgtcttcgtatgcgttatcagaaggagaatcgctatggcaactttgttacaacttcattttgcttttaatggcccatttggcgacgcaatggttgagcagcttgaaccgcttgctgagtcgattaatcaggaacctggttttctgtggaaggtatggacagaaagtgaaaagaaccacgaagccggtgggatctacctttttactgatgaaaaaagcgcccttgcctatctggaaaaacatactgcccgactgaaaaatctcggcgttgaggaagttgtcgccaaagttttcgatgtcaatgagccacttagtcaaatcaatcaggcaaaactcgcctgacagaatttaatcaagggcggttagcgcccttttcatccctgtctgaaatttctcaaattctaaaaatctcaaccaaacttatctgataacactaaattcgaaagaatgcgtacaggtaagtaacaatgaaaaaaattgctattgtgggtgccgggcctacggggatctacaccttattctcgcttctacagcaacaaactccactttctatttctatcttcgagcaggctgatgaagccggtgtcgggatgccatacagtgatgaggaaaactcaaaaatgatgctggcaaatattgccagtattgaaataccgccgatttattgtacgtatctcgaatggctacaaaagcaagaagccagccatctccagcgttatggcgttaaaaaagaaaccttgcacgatcgtcagtttttaccgcgaattctgctgggcgaatatttccgcgatcaatttttacgattagtagaccaggcacgacagcaaaaatttgcagtggctgtttatgaatcatgccaggttaccgatctgcaaattataaatgctggcgtcatgctcgctacaaatcaggatttacccagcgagacgtttgatttagcagtgatcgcgacgggtcacgtctggcctgatgaagaagaagcaaccagaacgtattttcccagcccgtggtcaggcctgatggaagcaaaggtcgatgcgtgtaacgtgggtattatgggaacatccttgagcggactagatgcggcaatggcagtggctattcagcatggttcgttcattgaagatgataaacaacacgtcatttttcaccgcgataacgcaagtgaaaagctaaatattacgttaatgtcgcgcacgggtattttacccgaagccgatttctattgccctattccctacgagcccttacacatcgtcactgatcaggcattaaatgctgagattcaaaaaggcgaagagggccttttggatcgggtatttagattgatagtagaggaaatcaagtttgctgatccagactggagccaacgcatagccttagagagcctgaatgttgattcctttgctcaagcctggtttgccgagcgcaaacaacgcgacccatttgactgggcagaaaaaaatctccaggaagtcgaacgcaataaacgagaaaaacatactgttccctggcgttatgtcattctgcgcctgcatgaagccgtacaggaaattgttcctcatctgaatgaacacgaccataaacggttcagtaaaggccttgccagggttttcatcgataattatgcggcaatcccttcagagtctattcgtcgcctacttgccttacgtgaagcgggaatcattcatattctcgccctcggtgaagactacaaaatggaaattaatgagtcgcgcaccgtcctgaaaacggaagacaacagctactcgtttgacgtttttattgatgcccgcggacagcgtccgcttaaagtgaaagatattcctttccctggactacgcgaacaattacagaaaacaggggatgaaatccctgatgttggcgaagattatacgttacagcaacccgaagatattcgtggacgcgtagcgttcggcgcgttgccctggttgatgcacgaccagcctttcgttcagggacttacggcatgtgcagaaattggtgaggcgatggctcgggcggtcgtaaagcctgcatcccgtgctcgtcggcgtctttcgtttgattaaaggtaaagctatcagcactcaacaaactgatgctgttcattaagacgatagcggactccggttcgaatattgttttcaccttcaatggcgacggcgaagcgaactctttcgccgtcatgatatgccagtgcggcgcttccccctggcccgagaataattgagtcgaccacgcccgtgctcactaccgttgaattttcaccgctggcaatgatgtgtacattgtcgccgctgttggcaattctggcgtttgcgccaaagctggcgatttgcaccaggtcaccattactggcgacatgacatcgttcacccaatgtacaaacgcgtactcgcattccagtattcgcaatccgactactatctccagcgctgcttatccgcgaagaattaccggttacagcaacccgtgcgcgttcaccggagctgccaatgtgactgttaaagccgacacttccaatccgcacgctataacccatactggcaatttgcgcggcatacccagcggttgcgattctggcattatcctcacaacagccgatgcgagcgtgatcgtcgctgcgggcaaactgactgcaaaatgctctctctccgggatctgtggccagtttttgcatagaagaaacttcctgatgcgcgaagttttcatccgccagccattttttccacgcatactcaaccagactctccgcccagtccgtatatccttcctcaatcagtgcatgatgaatatcggcataactaccgccgcgtgggaaatggcgcaggaaccagcgatacatcaccgctccgatacgccattctcgcaggcctgctcgtgtaatgatcattcgttagtgccggtgatagccatcgaccatgcttttaaaggtttcgtgtggcgtacgccccgtggtgcaaagataaagatgaccgaagataaaaaagaggcttataaatgccagagcaaaatgcgcctgcaataaccagtatcttacgccaggaaacacatctcccacggcttgcggatagagacacagcagccccgtcaatagtaacaacggcagcaatccaaacatgacaccaatataggcaacctgctgtaagggattaaatttagactgggttgttgccgggaaaggatgttcttccccctgcataatgccaaacaaataaaatcgcgtttgttttgccgctcgctccagccaaccctgacgacgaatgcgatagtggtgaccattacccccaacggcattgatcagaacaaagccgagccagcatgccagtaacaaaaatccgcaaacttcatgcaacgcaaccagacttttaaccgcagttgcgcccaccagcgcaaagtgatttatcagcccacttgccagcaacaatacaaagagtaacgcattcgaccagtgccataatctgaccgctttgctgtaaagataaatcttctcaccatgatcggtggctgatttcttcacgccacgagcacgaagcaaggcatgcagccccagcaccaaccacatcccaaccagcaatagtccggcaatgatcaaccacaccggccaaaattcgggagtgaattgtggcacatagttcgccaactggctctgaaactgttcagcatgttgcgacgggttcatacattttcctttttaatcaaatgttgaccgaatcggcgatacagatgcggtttcccggcaccaggtagctgatattgatagtatttattttcctgcaaccacgcctgaatttctgggctatcttcgcgaccaaagatcaatgcatgttccggacaggcgctgacgcaaatgggcggaaagccttttgccagtcgggactcagcgcagaaatcacatttatctgccactttagtgacagggttaaggtagcgaacctggtaaggacaagcgccaatgcaataactgcagccgatgcactgcgatttttctacccgcacgatcccctgctcatcacgccacgacgcccctgtcgggcatacgtcgatgcaaggagcatcttcacagtgctggcatgactggcgaaaatagtgatactgcgtttcgttgtcgttatcggtgactggaatgtgtgctatcgataaacggcttccctgagcggggacgtggttagttttacggcatgcgcgggcgcaaatattacagccattgcaccgtgactcgtcatgaatcatggcataccgaactttcttttcttgcctcgtgttcgctaacagagaagacgcagaaccagtaaaaaagattactgttcccatccccagaacaaatttgcgtcgagtgaaggacatctgattatcccctaatgcagtggctgcaactgtccaccctatccatgacatctccctgaaatttcaggggttctgaaactgctctacctcaaaccattcgcataagccatacgccttgccataggtcataaatcgctcgctaaacaagtacaacaccgccgtcgatgactccacctgccgtatatcagcatattcaggtgcaatatccatcgcggcgatcgcggcttcgatctgcgcttcctggaagtaatatggcgcttgcatcagcatggcgactttgtaaggacgaggatacgtctggcactcaaaacgaacggcgtgtgcaatggcgcgacaaatgtcctgctccacaacttgcaaagacatcgccgcgtagttttcactcatggcctgcgttgagtaatagtaatcatcctggcttcccgtcaaacaagcgatatccgcgtggtctccgttctgcttaatgctttccagcaaaactgacagttcctcttctgcaaccgaatagggtggcgagagaaacacggcgcgcgccaccagctgcccagcagcagaatgctgacgaatgaactctgccaggatttcagcaggttctggttcggttaccgtatcaacggggtgacgcatcccctgcaaccattgccgcttcgcctcgtcaatttcgctgacttccgctaacggcaattcatcctgatggttcatctcacccattccttacgcaggcagtagattgtgtgctgccagatcggcggcaatatcttccagccccagacgctgcaatgtttcacgggtcggacaaccaagcagtgggtcccagcccatttctttgtagaacatcgtgagcgaagcatgcatatcgtcacggtccattttgtccgtaccttcagtaaagaccgggatctgaggatccttgtcgaatacccaggaacagataagatcgtgttcattacgcatatctttggtttgcatcagttttaccgtgtaggcgcgatgcaacgtaaagatacgctctgcagctaaatctaatttttcctgagtcatctcttcgccagtgatcgctttgaagaatttggcttcaagcgccagatcgccccggtaattacggcttttcagcggcgaaacggtcattggccagacccagttgcacagggtgacggcattatgcaaacagacccgcaacagcgaccacttagcatatttaatttttgcgtcattgattggcgtgtagtttttggtttcatcgtaagcatcttcagaaccaaaaagttctttcgccacttcacgttgcagtttcaatggcaagccggaaccaataaagttgatatgggtatgcgtcatgcagtcacggttgaacatacagttaacaatggaaccgacctgcgctgacgcttcattggcatggtgaaccggatagccaaatggcgaccagagtttatttttcgcgtagccccagtactcttcacccaaattccagcgttctgcgatggcatatgaaccatcagccaggtgactcagctcacccacacgatgcgccagacggtagtaaaaatctttaatgaagttaacgtcacccgcttccagttgatcccagcgaatttccgcatactcttcagctggtagaacacgcttgaacacccctttgctgtaacaataagtaaagtcgcgatgcagctgcccatagttacaccataggccgtagtcatcgaatagattcagaccaaccaggttaccaatcacacgaccatcgtctttatcttcaaaatctttcggcccgtttgggaagatggtggtatggacaaagtttgctacacaagtgttaccacctgtgccaggcacgccaaactctttcactcgaggaatattcatttgggtcatacaacggatcgggcaagaatggcagccgctcatttttactgtgtatttctctgccgccggacctaagtcaaaaacggatttataggtacgaaagccgaccgtgttctgattgcctggcggaatttcccccgtttcaatcggaccaccttcagccgcgccccaaaacagccctttacgtgctgtccaacgtgacttgggatctgaatactctgcccacgattgcggcgtacttggcacgacatggttgttattcgcaccgataagttcagtcatcatgtaatcgttgagacgcttcatctcctgacgatcggcaatgttgacccctttcgtcccctcaatcgcaatcgctttaaggtttttcgaacccattattgcgccagttcctgcaccaccgctgtggttacggctattcaacatgccagagagaggaacaaggttttccccagcctgaccaatagccgccacacaggtttcagggctggtcaatcgacaaatctcttccgtcgttgcgcgcgtaccttttccccataagaaatcggctttttccaggctaactttgtcatctttaatattcagccataccggtgatttcgctttcccttcgataataatgacgtcgtatccggcgaatttcatttgcgctgcaaaaaagccccccatatgggcatcgacgactaaatttcctttggtaaaagtagaaagtgaggtgatatttacgcgagaactgcagggggcaccagatccagttaatgggccggtagcaaagactaatttattcgcttcatcgaaaggtttcgtgcctggcggtacttcgtcatacataattttgtagccgaagcccataccaccgacaaaacttttaaacttactggaatcttcgagggtaatatttcctgtcgtaagattgactcttaatatattacctgtccaaccgttagccatgattttttcctttgcaagattcacacagtaatatctttccactcgataatttttaacgcccctgttgggcaggcgtatgcgcattcaccgcataacacacatttcgaggattttttactttcggtatttacggtggccatcatccacgggcatgccgtagtacaggcgctacagccaatacaacgtttatgatcgacggtaatacagccttctttctgctgccaggtaatcgcaccaatcgggcagacgttcatgcattgcggctctttgcattgacggcaggtgtccgcggtatagttgagatcgccatacaggccgccgccagagccaaccccgttgtcgccaaagaaataattgcgatggattttgatacgggagaagaatgtccctactgaaccatcgttgaagttggtacaagagatttcacagcggtggcaacccgtgcatcgagcacgttgggtcaccagcacccctttgggtgtatttatcaaccctactgtgccgctatcaatatcttcctgtttgcaacccaaaagtgacagtaacgcaggggcaattgttaaaccagcgaggccttttcctgatatacgcaagaattctaatcgcgttaagccaatatctaatagtggacgatcaaccgggttcatttatttcgcatcctcttcgcaaacacagtgctgacaattcagcagactgatattaagcattcaactaatacgctgctgactctgtccccaacaccagatattttccctaacccgatagtgtatgagaaaagatttaacgctgataaactaatcctttatggttaggagaaaaaataatgtgattattctgggcccttaacattgatcgttatcaattaaaatcacaaagcaagaaattataagtgaactgatatttattatcatttgaaataaatttaacttaagcgacaattatttgtgacgttcattgcagaaaataaaaataacattatcgttataaattaaaatacataccgaaattcgtataatttcagcagttgttatttagaatgattaacttgaccgcaactgaagcaagaatatcaggatgaagcttaccgcctcatcctgaatggtcattttaccagtgcgttaatgacggtttccatcgcctgcttttccagctcactgcgctgaatgcgtttattggctaatgctgtacgtaatacgcctgcgataacaatatgctttggttcctgccccagatcgcgcatttccagcacaactttaccgacaactctgcacatttctcggtacagttcatcctcttttgtccgatttcccattctttatacctatttatcatgccaactatcagcatatatcaatctaaccaattagacaaaaatcaaacaaaatcagacaaataacgcgataaattattttaactgtagcaattgagcgatgatgtatttatacaccggatgaactttcacttatcttcacagtgacaaccccggcaccagacgttgcgcaaacagcgaagtttttgcgtaaccttttccctggaacgttaaatctttgataacaatttattgtcttacaagttgtatattttttgaaacgctgtttttgttttccttttggattaatttcagcgtataatgcgcgccaattgactcttgaatggtttcagcactttggactgtagaactcaacgactcaaaaacaggcactcacgttgggctgagacacaagcacacattcctctgcacgctttttcgatgtcacctatccttagagcgaggcaccaccactttcgtaataccggattcgctttccggcagtgcgcccagaaagcaagtttctcccatccttctcaacttaaagactaagactgtcatgaaaaagaccaaaattgtttgcaccatcggaccgaaaaccgaatctgaagagatgttagctaaaatgctggacgctggcatgaacgttatgcgtctgaacttctctcatggtgactatgcagaacacggtcagcgcattcagaatctgcgcaacgtgatgagcaaaactggtaaaaccgccgctatcctgcttgataccaaaggtccggaaatccgcaccatgaaactggaaggcggtaacgacgtttctctgaaagcgggtcagacctttactttcaccactgataaatctgttatcggcaacagcgaaatggttgcggtaacgtatgaaggtttcacaactgacctgtctgttggcaacaccgtactggttgacgatggtctgatcggtatggaagttactgccattgaaggtaacaaagttatctgtaaagtgctgaacaacggcgacctgggtgaaaacaaaggtgtgaacctgcctggcgtttccattgccctgccagcactggctgaaaaagacaaacaggacctgatctttggttgcgaacaaggcgtagactttgtcgctgcttcctttattcgtaagcgttctgacgttatcgaaatccgtgagcacctgaaagcgcacggcggcgaaaacatccacatcatctccaaaatcgaaaaccaggaaggcctcaacaacttcgacgaaatcctcgaagcctctgacggcatcatggttgcgcgtggcgacctgggtgtagaaatcccggtagaagaagttatcttcgcccagaagatgatgatcgaaaaatgtatccgtgcacgtaaagtcgttatcactgcgacccagatgctggattccatgatcaaaaacccacgcccgactcgcgcagaagccggtgacgttgcaaacgccatcctcgacggtactgacgcagtgatgctgtctggtgaatccgcaaaaggtaaatacccgctggaagcggtttctatcatggcgaccatctgcgaacgtaccgaccgcgtgatgaacagccgtctcgagttcaacaatgacaaccgtaaactgcgcattaccgaagcggtatgccgtggtgccgttgaaactgctgaaaaactggatgccccgctgatcgtggttgctacccagggcggtaaatctgctcgcgcagtacgtaaatacttcccggatgccaccatcctggcactgaccaccaacgaaaaaacggctcatcagttggtactgagcaaaggcgttgtgccgcagctggttaaagagatcacttctactgatgatttctaccgtctgggtaaagaactggctctgcagagcggtctggcacacaaaggtgacgtcgtagttatggtttctggtgcactggtaccgagcggcactactaacaccgcatctgttcacgtcctgtaatattgcttttgtgaattaatttgtatatcgaagcgccctgatgggcgctttttttatttaatcgataaccagaagcaataaaaaatcaaatcggatttcactatataatctcactttatctaagatgaatccgatggaagcatcctgttttctctcaatttttttatctaaaacccagcgttcgatgcttctttgagcgaacgatcaaaaataagtgccttcccatcaaaaaaatattctcaacataaaaaactttgtgtaatacttgtaacgctacatggagattaactcaatctagagggtattaataatgaaagctactaaactggtactgggcgcggtaatcctgggttctactctgctggcaggttgctccagcaacgctaaaatcgatcagctgtcttctgacgttcagactctgaacgctaaagttgaccagctgagcaacgacgtgaacgcaatgcgttccgacgttcaggctgctaaagatgacgcagctcgtgctaaccagcgtctggacaacatggctactaaataccgcaagtaatagtacctgtgaagtgaaaaatggcgcacattgtgcgccattttttttgcctgccatttaccgctactgcgtcgcgcgtaacatattcccttgctctggttcaccattctgcgctgactctactgaaggcgcattgctggctgcgggagttgctccactgctcaccgaaaccggataccctgcccgacgatacaacgctttatcgactaatttctgatctacacccttattgtctttaaattgcgtaaagcctgctggcagtgtgtatggcattgtctgaacgttctgctgttcttctgccgatagtggtcgatgtacttcaacataacgcatcccgttcggttccacggaatatttcaccggttcgttgatcactttcaccggcgttcccgtccgcacgctggagaacaaggctttaatatccggtgcattcatgcgaatacaccctgaactgacgcgcaaaccgacgctgtccggcgcactggtgccatgaatgaggtattcgccattaccatgcgcgaggcgcagtgcgtaacgtcctagcgggttatttggcccggcaggaacgactggcggtaatttaatgccacgctccaaagaacgctgacgaatgcccgccgtaggcgtccaggttgggttagggattttctgccccacacgcgtttccatcactggcgtttccagcccctgcaaaccaatacctatcggatagacctgcacgatattttctcccggcggataataataaaggcgcagctctgcaaggttaacgataatcccctgacgcggcgcatcaggtaataacagttgcgaaggaatagttatcgtcgtaccaggttttggcaccggggcgatagtgttattggcttcaaggatcaacattgccgcagtatcaaaacgtcgggcgatggcctgaaggtttttatccccttcctgcaccgtatacgtttgattttgcccaaccagtcggcttccggttggaggtagcggataatcaaccgcccaggcagcctggatggcgctaaaagcgccgataagcgtgagtgtaagcaaagacgcgcgtttcattgtaaacctcctgtatttgccggagactcacgctgaaacgtcggatggcgcttatgttcacctgaaaccaaaacactcctgtgcaggtcagtgtaaacattgaccatccggcaatgtgagccaaccggatgaaagctgttcctttagtttagctaagtgcagcggctttggcgcgaattgcgcgaatcatcgcttccagaccttgtgaacgagatggggtgagatgttgagtgagcgccattttttcaaaccacggacgcacatcgaaattgacaatatcctgcggcgtcatctgatcgtagagaataaagacgaccgcaataagccctttcacaatcgccgcatcgctgtcgccctgcaatttaataattccctgcgcattctggcgcatgacaatccacacctgactctggcagccctgaatgctattttgtgagcttctgtcttcgtcgcgtaattctggcagacgctggcccagctcaataatgtagagatatttctcttcccagttggcgcagcgtaaaaaattacgcagcaatttttctttatccggcaataaagccatagtgcctccctgttatcccagcagacggtgaatacgttgcaggccggtcaccagacgatccacttcttcatgggtgttatacatggccagcgacgcccgacacatggcaggaacgttgtaataggccattaatggcatagcgcagtgatgtccggtacgcacagcaatgccgtaattatcgagaaaactgccaacatcataggcgtggtgtttaccaagattaaaagcaataacgccaagtctgttctggggaccatagagagtgagatccggtacagattccagctgtgatagcgcgtagtgcatcagattctgttcatactcggctatattattaagccccagcgccgacacatactccagcgccgcgccaagaccaatgatgcccccggtattgggtgtaccggcttcaaaccgccaaggtgctttggtccaggtagtgccttcactcaggctgacggtggcgatcatagaaccgcccccttcccacggcggcatctcctgcaacaaggcttctttgacataaagaatgccaatcccagtggggccatacagtttatgcccggagaacacgtaaaaatcgcaatccagcgcctgaacgtccaccggatgatgcatcaccgcctgagcgccatccaccagtacttttgtgccatgctgatgcgcaagcgtgatcatttccgccagcggattttccgttcccagcacgttggagacatgagtaattgccagcaggcgagttttctcatcaaacagcgtaggtagcgtctccagttgcaacgtaccgtcgggattgagcgggatcacacgcagctctgcgccaacgcgtgcgcaaagcatctgccagggaacaatgttagcgtggtgctccatctgactgatgatgatgttatcgcccgcccgcacattgctgttaccccagctattggcgaccagattgatcccttccgtcgtgccgcggacgaacaccagctcttccgccgaacgggcattaataaacagcgatgcccgcttgcgcacgttctccattttctcggtcgcctgggcgcttaaggtatgaataccgcgatgcaccgccgcgtagccatgacgataaaactcggcctcggcgtcaatcacctggctcggtttctgtgcactggcggcgctgtcgagataagccagcggcaaaccgtttacctcacgcgaaagcaccggaaagtcggcccgcactttgtcgacggaaaaagtcatcttgcacctcctggcagtcgttgaccgattcgggccagcacctgctgtttaagcccctcatcacgcagtgcttccgtcagttcagcagcaaaggcgtagatgatcatctgctgggcatcttgctgattgatcccgcgcgagcgcagataaaacatctgttcgtcatcaatacgccccaccgtcgcgccgtggctgcatttcacatcatctgcatagatttccagctgtggtttcgtatccacttccgccagtttgcccatcagcagattattgttggtcatctgaccatccgttttgatggcgtgctgcgcgacgttgatcaaaccgttaaataccgcgcggcctttgtcgctgacgatagttttgtgcaactgtcggctgttacaaaaacctttattgtgttccagccaggtacgggtatcacacacctcgtttttcaccggcatcgccaggctattgatccgcagcgtgctgttttcgccattgagttgcgaactggtgttgtgtcgtaacactgcgccacccagcaggtaactgtggctaaatgcggtggcatcgtctgccagcaacaaatcgttatgggcaaagtggtgactgagcgggttttcaaacgccagcttgatatgctgcaagtgggcgttcgctgcgacattgatagtgaaccgtgccccagtaaaatgacgagcatcattaaggctgacaaaatgttcgatcaccgttgcttcggcaccttccgccagatccagatgatgtcggtaatgggcagtgttcacctcttcacctgccacgccctgggttatatgcattaacagcaatggctttaccggccgttgaccgcgcttcacggcgatatgcgtcacgctatgcgccaggctttccgtcaaatgcagaaacacttccgcctgaatagcgtcgggtaacccctggcggtcatcgttaatgctcacttcatatccgctgccttcagttgcatcgctcagtgctgacacgtaacgtccatcgacaaataccagccgcacagcgtctaacgttaacgctaaggcatctcgctgctgtggggatatctctcccgcaatgcagacaaactggctattggtcagcccttccagcggcgtatatttccagttttcatgtttccgtgtcggcagtccggtacgcagcaattgttgtaaatgctgctgtgcttgcggggagcgttttgcaccctcggcttcaaacaagtgatgccactgttgcagcgcgttactgctgttcggtaagccagccataaccctgctcctccagttgtttgaccaacgtgaaatcgccggatttcacaattcgtccctgatacagcacatggacgtaatcaggcttgatgtagtcgagaatgcgttggtagtgcgtaacaatgatgaatgaacgcttgccgtcacgcagcgagttcacgccatcggcaaccacttttaatgcgtcaatatccagcccggagtccgactcatcaagaatacataactccggttccagcaccgccatttgcaaaatatcgttgcgctttttctcgccgccggaaaaaccaacgtttaccgaacgggttaataaatcttccggcatcttcaggagagcgattttctcttccatcaaatcctgaaaatcaaagcggtcgagcgtttcctggccgcgatagctgcgcaccgcattaagtgccgtttgcaggaaaaactggttactgacgccgggaatttccaccggatactggaaggccataaagatgccttcacctgcacgatcttccggcgacagcgcaagcaaatctttgcctttgaactcaaccgcgccgcccgtcacttcataatcttctcgcccggcaagcgttgccgataaggtacttttgcccgaaccgtttggccccataatggcgtgaacttcgccgggacgaacgtcgaggcttaatccacgcaggatagctttatcttccacgctgacgtgtaaatctttaatacttaacatgtttattccttatccgacgctgtgttcaagactgatggcgaggagtttttgtgcttcaacggcaaattccagcggcagttctgagaacacgtctttgcagaaaccgttaacaatcatcgagatggcatcttcttcgctgatcccgcgttgcaggcagtaaaacagttgatcttcaccaatacgtgatgttgttgcctcgtgctccagttgtgcgctgttattgcgacattcgacatacgggaaggtatgcgccccacaattagcgccaatcagcattgagtcgcactgagtgaaattgcgcgcattggttgccgtcggcatgattttcactaagccgcgataactgttctgactatgtccggcagagatccctttcgagataatggtcgatttagtgtttttaccgatgtggatcatcttggtgccggtatccgcttgctgatgaccgctggtcagcgccactgagtaaaactcaccaatggagttatcgccgcgcaaaatacagctgggatatttccacgtaatcgctgacccggtttctgattgcgtccatgacattttgctgttttcgccttcgcacaaagcacgcttggtgacgaagttgagaataccgccggtgttgttatcgccagggaaccagttttgtaccgtggaatatttcacctcggcgtttttatggatgatgacttccaccaccgccgcgtgtaactgatagctgtcacgcaccggagcggaacagccttcaatgtagctgacgtagctgtcttcgtcggccaccagaatggtgcgctcaaactgcccggttttttccgcgttaatgcgaaaataggtggaaagttccatcgggcagcgcacgcctttaggcacataaataaacgtaccgtcagaggctaccgccgcattaagtgcggcaaagaagttgtcattccccggcaccacggtgccgagatatttacgcaccagttccgggtgatcgtggatcgcctcgccaaaggaacagaaaataattccctgctccgccagtttttcgcgataagtggtggcaaccgaaacagagtcgaaaatggcgtccaccgccacctctttgccttcccgcacgggaacgcccaactgctcaaacgccgcctccacctctttacttaaaaaggcgttcgcgccagtttgctgcaccgcgccgggttcagacgcgcagttgtcgtcacaattaccgcacgatggtgctgagtagtagctgtaatcctgataattcagcttgtcgtagtgcgctttcaaccagtgcggttcttccatctccagccatgcgcgataggcgttgagacgaaactccagcatccactccggctcattacgcttcgccgaaattgcgcgcaccacctcttcgtttatcccctttgccagctcatcggtggctaactgggtgaagaatccttctttataattcagcgggccgccggtccaggttttgacatcgtcagttgcttcagtattacgagacatagtaccgcctataccccaaagctttcgccacagccacattcattctgggctttagggttgtgaaatttgaatatctgattaagtccttcacgaacgaaatcgacttccgtgccatcaataaacggcatcgcttgcagcgggacaaacagcttcgcaccgtcgtgttcaaacagcagatcgtctttgtccggctcgctaacactgtcgagcacatagccaaagcccgcgcagcccgtttgcttcacgcctaagcgcacgccgaccatacccggctgctttgccaccagctcgcgtatgtggacagcggctgcgggtgtcagcgttaagccctgccaggcgaaatcctgtggattaaaggttcctgaatgcatgtccatcgatttacctcacttcatcgctttcagcgtataacagcatgttagtgataatgattatcagttcaacccagcaaacgcaggggctttaccgtaaaacatgcttttttcttgcttttaataagcatagaccctgatgtgtgggttaacaggcacgctaagaattaggtatctcattgttagataatgattattatctaaggagcattaaggctgtgatgaaaaagaaaaagttgtattgaaaatgactatttaagagataggtaaaaaagtgcagcgttcagaaataagaaaacccttaagtctgtgcgacacaggcttaagggtttctaccccatccggcgcttatctccggcactctcagtggcttagctcttgaaggggcgataagaataatctcataaagctaagccgtcgttttaacacaaactgcgattagtattatttttgaacaatatcaggcggttagataagcagtattaagaaggttatcgaacctggacggaggttaatccaggtcgatttggcgaaattgcagcattaagtcaggatcaatgcacgcccagacgccaggcaaagtagatttcttcttttaattcagcagaagagagagtaagcaggtcagcaaattcaagttctagttgtttcagacgtttgagatattgggcaggtgaaagattgctctggtcacggcgtaaaaattcaatggccagctgggtgggatcaagttgagtagacatagcatcctcgcttttagacaagacctgcacagtataccaccgtttactgtgcagataataaccaaaagcaatatgcgtcacacttttctggtgacaacgtcacaaaatggcggtcgttaatcgtgacgaacagcacaaacgccctttctcatcgaagatttcaatctgccagacctggtgacgcgaaccgagatgcaacggtttgcatacgccgcgcacccgcccttctcgtgccgagcggacgtggttagcattgatttccagaccaaccaccttttgctcaccttcggtacataaataaccggcaacggaaccgatactttcggccagtaccacggatgcccctccatgcagcaacccgaaaggctgctttgtccgcgagtctactggcattgtcgcttcaagggtgtcatcaccaatatgttcaaagcgaatatccagcaaccccaccatgtttccttcacccatggcattcagtgcttccagggtgatttttcgtttccatatcatttaataatctccagtaaagcctgcacaggatggcgtacccccgtgccttcgacccgttttacctggctacggcaggaatatccggtcgccagacagcgattacgcggcagtcgctgcatcgcctgatgccaggataactcatagatcccgagcgaatttttatggtttttcgcttcatgtccgtaagtccctgccatgccgcagcaacccacgctgacattttccagtttcgcgccaaaacgggcaaatatcgcggcccattgtgctggcgcgcccggcaaagcggtaacttcggtacagtgaccaaagaaataccatgattcaccgctgactgtagccactggctgtgagtcaagtgcgcttgccagccattcattcgccagtaagacgttaaactcgccacgttcctcgcccagcgccagtttatattcatcgcgataacaaagtaccagcgccggatcgacgcccaccattggcatccccagcttcgccatacggttgaggaaatccgccgtctttttcgccgtcttcgcaaaacgattaagaaagcctttgatatgctgggctttgccatttggcgaaaatggcagtaacacaggctggaaacctaatttttcgaccagacggacaaaatccgccaccacttgcgcatcgtaatagctggtaaaggggtcctgcaccaccaacaccgtgcgcgctttctgctctgcattgagagcttcaagctgttccagcgtcatattcgccgagcgatgccccaccatttgttgttgcagcgaggggaccgacagcagcggcaaatcaaccatgccaatatgtttttccgagagtttgcgcaccagcggctggttaatgaagaagttaaaggttttcggcgcgcgtgccatcagcggtgcgtagctctcgaccgtagcgacaaggtggtcgcgcagagggcgtaaataacgggtgtgatagagctgcagaaaacgagagcgaaactccggcacatcaattttgatggggcactgggtcgaacaagctttacaggccagacagcccgacatcgcctctttgacttcgtgggagaagtcatattcgcctttattcgcatgccagctattgcgcgtgcgggcaattaacgtccgcaaactgacgccggattcaggcagttcttgttccagtttgagtgggtcaacgccgcgatccgccaacaagcgcagccattcacgcaccagcgttgcgcgccctttcggtgaatgaatccggttctgggtgatcttcatcgacggacacatcggactacggacatcaaagttgaagcataaaccgttgccgttacactccatcgcaccgcgccactgctggcgtaccgcaatggggatctgccgatcgaatgtaccgcgcttcaccgcgtccactttcatcatcggcgcatcgagaccttctggcgggcaaatcttcccagggttgagtcggttatgcgggtcaaatgccgctttcactttgcgcagttctgcaaaaagttcctcaccgaaaaacgccgggctgtattcagcgcgaaaacctttgccgtgctcgccccacaacaagccaccgtatttcgcagtcagcgccaccacgtcatcagagatttgcttcatcaaaatctcttgttgtggatcgcacatatccagtgccggacggacgtgcaagacacctgcgtcgacgtgaccgaacataccgtagcttaagccgtggctgtcgagcagcgcgcgaaattcagcaatataatctgccagatgttccggcggtacgcaggtatcctcagcaaacggaattggcttggctgctcctttggcattaccgagcaggccgacagcttttttgcgcatcgcataaatacgctcaacacctgccagctcactgcatacctgccagccgatcacacctgcttgctgactggcgataagttcatccagccgcgcacagagtgcatttactcgctcatcaatcagcgtctcatcatcaccagcaaattccacaatgttcagcccgagcatttctttgtcaggcacatcggtaatcaactcgctgacggaatgccagacaatatcttcccgcgccagattcagcacttttgagtccaccgtctctaccgaaagcgcccgcgcctcaaccataaacggcgcgttacgcagcgcggagtcaaaagagtcatatttgacgttcaccagacggcgcactttaggcaagggcgtaatatccagccgcgcttcggtaataaaggccagcgtcccttctgaacccgtcagaatgcgcgtcaggtcgaactcggtcatctcatcgttaaagacatgacgcagatcgtaaccggtaagaaagcggttaagtttggggaagttgtcgatgattaactggcgttgctgacggcaacgttgataaaccgtgttataaattcgcccgattgcggtattggttttacccagcgtttctgccagttcgacgggtaaagattgcgtatcgagaatatcgccccccaacaacaccgcgcgtacgccaagtacgtgatctgacgttttgccatagaccagcgatccctgaccggatgcatcggtattgatcatcccgccgagcgttgcccggttgctggtcgaaagctccggcgcaaaaaagtagccgaacggtttcaggtactgattgagttggtcttttatcaccccggcctcaacgcgcacccagccctcttcagggttaatttcgatgatgcggttcatatggcgggacatatcaacaataatcccctggttgagcgcctgaccgttagtgccggtgccgccgccgcggggggtaaagatcagcgatgaatagcgttcctgcgcggcaagacgggcgatcagcgccacatctgcggttgaacgcggaaataccaccgcatcggggagaagttggtaaatactgttgtcggtcgacattgtcagacgatcggcataacttgtcgccgtatcgccggtaaacccctgttgctccagctcttgcaaaaaattaagcaccagttgaacgacgccgggtgcctgggaaatctgtggaatcattatattgaccctttcctgcggtctgtgatgtaggtcgatacactattctttcaggcggctgcaatagcgcactgaaaggtgatgtttatttactctatggatttcgagttgcaggaaggcggcaagcgagtgaactccaggagcttacaatagtaagtgactggggtgaacgaacgtagccgcagcacatgcaacttgaaatacgacgagtaaatcgtttgcgtgttgcctgagttgttgtaccacatttttttctaacacgcccatcagaattaagggcagaatcggcctgttaaaaaccgctgaaattgctcatcattatgcaggtgagtttcgcgtgttcacgtcgcgtcgacgatttgacgcacaaaaaaggtgaaaagtagttatggtaaatgttcgtcagcccagggatgtcgcacaaattctgctttcggtgctctttttagccatcatgattgtggcatgtctgtggattgtacaaccctttattctcggctttgcatgggctggtacggtggttatcgccacctggccggtattgttacgtttgcaaaagatcatgtttggtcgccggtctctcgccgttctggtgatgacgctgttattagtgatggtgtttatcatccctattgccttgctggttaacagtatcgtcgacggcagcggcccgctaattaaagccatttccagcggtgacatgacgttacccgatctggcgtggcttaataccattccggtgattggcgcgaagctgtatgcaggctggcacaacttgctggatatgggggggacggcgatcatggcaaaagtccgtccttatattggcaccaccaccacctggttcgttgggcaggcggcgcatatcgggcgctttatggtgcattgtgcgctgatgcttctcttcagcgccctgctgtactggcgcggtgaacaagtggcgcaaggcattcgccattttgcaacccgtctggcaggcgttcgtggagatgccgccgtgctgctggcggcacaagctatccgcgcggtggcgctgggtgttgtggtgacagcgttagtacaggcagtgcttggcggtatcggcctcgccgtatccggcgtaccttatgcaactttgctcacggtgttaatgatcctctcctgccttgtccagcttggaccgttgccggtactgattccggcgattatctggctctactggactggcgataccacctggggaacggtattgttagtgtggagcggtgtggttggcacgctggataacgtcatccgcccaatgttaattcgcatgggtgccgatttaccgctgatcctgattctctctggcgttattggtggtttgattgctttcgggatgatcggcctgtttattggtccggttctgttagccgtttcctggcgtctttttgccgcgtgggtggaagaagtcccaccgccgactgaccaaccggaagaagttctcgaagaacttggcgaaatcgagaaaccgaataagtaatttctcatcaggcggctctgccgcctgattgttaacccctgctaattgatatttgcttgctcttccccatattttcctgcttaccgccattcagctggtagtacctgtcgcaaattctttacagtttttaaactaatgagacgaatctgatcgacgcaaaaagtccgtatgcctactattagctcacggttataaatcaacatattgatttataagcatggaaatcccctgagtgaaacaacgaattgctgtgtgtagtctttgcccatctcccacgatgggcttttttttaacatttttccgcttcgctacctcgcccctcacgctttccaataatgttgcacaagatactgtgactctcttcaagccgtcagcaggctgataatgttatttatattttattgtttatttcatgcagccattacacgatgaacgcttatgaactccaggcactccgccatatttttgccatgactattgatgaatgcgcgacctggattgcccagaccggtgacagtgaaagctggcgtcaatgggaaaatggcaaatacgccattcctgatcgtgtagtcgagcaactgttggctatgcgtcagcaaagaaaaaaacatcttcatgccatcatagagaaaataaataaccgcatcggcaacaacaccatgcgttttttccccgacttaaccgcgtttcaacaagtctaccctgatggcaattttattgactggaagatctatcaatcggtagccgctgaattatatgcacacgatctggagcgcctttgttaattttccaaagaaaggaattgtcgttgttacaacaataatgaacggatgctgacacaacatcgcttcactttttaaagcacctttgctaagtagaacctatgaaaaatccctatttccctaccgcactggggttgtattttaattacctggtgcatggtatgggcgtcattttgatgagcctgaatatggcctcgctggagacgctttggcagactaatgccgcaggcgtctcaatagttatctcatcgctgggtattggtcgattaagtgtcttgctttttgcaggattattatccgatcgctttggtcgccgcccttttatcatgctcgggatgtgctgctatatggccttcttttttggcatcctgcacaccaataacattattatcgcttatgttttgggctttctggcgggaatggcaaacagttttctcgatgcaggcacatatcccagtttgatggaagcttttccacgctcaccggggacagccaatattttaattaaagcatttgtttccagcggacaatttttgttaccgctaatcattagcctgttagtgtgggctgaactgtggttcggttggtcctttatgattgctgcaggcattatgtttattaacgctctgtttttataccgttgtacgttcccaccccatccgggtcgtcgcttacctgtcataaagaaaaccaccagatctacggaacatcgctgttcaattatcgatttagccagttataccttatatggttatatctcaatggcaacgttttatctggttagccagtggctggcacagtacggacaatttgttgcaggcatgtcatacactatgtcgatcaaactacttagtatctacaccgtgggttcgctgctttgtgtatttattaccgctccactcattcgtaataccgttcgcccaacaacattactgatgctgtacacctttatctcatttattgctctgtttaccgtctgcctgcatcccacattttatgtggtgataatatttgcttttgtcattggttttacctctgctggaggtgttgtgcaaattggcctgacgttaatggctgaacgtttcccctatgctaaaggtaaagctacagggatctattacagtgcgggcagtattgcaacatttaccattccgttgattacggctcatctgtcccaaagaagtattgccgatattatgtggttcgataccgccatcgctgccatcggctttttactggcactgtttatcggcttacgcagccgcaaagaaacgcggcatcactcgctaaaggaaaatgtcgctccgggtgggtaatgcaatattcttttcaggtcatgcaagatcttacggataaataactatttctgcgctaactaaggaaaatcgcgatcaaaaacaaactatgacatgcaatattcctggaaacataaactttatgccatgtacccagggaaaatcatcttcagtatagtaattatgtaaaccgtcggagaacaatacgtacggtaacgaaattatctttcagcaaggagctgtgaaaatgtctcaaaataaggctttcagcacgccatttatcctggctgttctttgtatttacttcagctatttcctgcacggcattagtgttattacgcttgcccaaaatatgtcatctctggcagaaaagttttccactgacaacgcgggcattgcctatttaatttccggtatcggtttggggcgattgatcagtattttattcttcggtgtgatctccgataagtttggtcgtcgggcggtgatattaatggcagtaataatgtatctgctattcttctttggtattcccgcttgcccgaatttaactctcgcctacggtctggcagtgtgcgtaggtatcgctaattcagcgctggatacgggtggctaccccgcgctcatggaatgctttccgaaagcctctggttcggcggtcatactggttaaagcgatggtgtcattcgggcaaatgttctacccaatgctggtgagctatatgttgctcaataacatctggtacggctatgggctgattattccgggtattctgtttgtactgatcacactgatgctgttgaaaagcaaattccccagccagttggtggacgccagcgtagctaatgaattaccgcaaatgaacagcaaaccgttagtctggctggaaggtgtttcatcagtactgttcggtgtagccgcattctcgaccttttatgtgattgtggtgtggatgcccaaatatgcgatggcttttgctggtatgtcagaagctgaggcattaaaaaccatctcttattacagtatgggctcgttggtctgtgtctttatttttgccgcactgctgaaaaaaatggtccggcccatctgggctaatgtatttaactctgcactggcaacaataacagctgccattatctacctgtacccttctccattggtgtgtaatgccggagcctttgttatcggtttctcagcagctggcggcattttacagctcggcgtttcggtcatgtcagagtttttcccaaaaagcaaagccaaagtcaccagtatatatatgatgatgggtggactggctaattttgttattccgctgattaccggttatctgtcgaacatcggcctgcaatatatcattgctctcgattttactttcgcgctgctggccctgattaccgcaattattgtctttatccgctattaccgcgttttcattattcctgaaaatgatgtgcggtttggcgagcgtaaatttagcacccggttaaacacaattaagcatagaggttaaaggagttaattatggatgttaccgcaaaatacgaattgattgggctgatggcctatcccatccgccacagtttatcgcctgaaatgcagaataaagccttagaaaaagcgggattgtcatttacctatatggcctttgaagtggataacgatagttttcccggagcaattgaaggattaaaagccctcaaaatgcgcggaactggtgtatcaatgccgaacaaacaactggcgtgtgaatatgttgatgaattaacgccagcggccaaactggtgggtgccatcaacaccatcgttaatgatgatggctatctgcgtggctataacaccgacggcacgggccatattcgcgccattaaagagagcggttttgatatcaaaggcaaaacgatggtgctgttaggggccggaggtgcctcaacggcgattggcgcgcagggggcaattgaaggtttaaaagaaattaaactctttaaccgtcgggatgagttcttcgataaagccctcgccttcgcgcagcgggttaacgaaaacaccgattgtgtcgtcacggttaccgatctcgccgatcagcaagcctttgctgaagccctggcttccgccgacattttaaccaatggcacaaaagtgggtatgaaaccccttgagaatgaatcattggttaatgatatcagtctgttacatccgggacttctggtcactgaatgcgtgtataacccgcatatgacgaagttattgcagcaggcgcaacaagctggttgcaaaacgattgatggatacggcatgttgttgtggcaaggggctgaacagttcacgttatggactggcaaagatttccctctggaatatgttaaacaggtcatggggttcggtgcctgacaggctgaccgcgtgcagaaagggtaaaaaatgaaaaccgtaactgtaaaagatctcgtcattggtacgggcgcacctaaaatcatcgtctcgctgatggcgaaagatatcgccagcgtgaaatctgaagctctcgcctatcgtgaagcggactttgatattctggaatggcgtgttgaccactatgccgacctctccaatgtggattctgtcatggcggcggcaaaaattctccgtaaaaccatgccagaaaaaccgctgctgtttaccttccgcagtgccaaagaaggcggcgagcaggcgatttccaccgaggcttatattgcactcaatcgtgcagccatcgacagcggcctggttgatatgatcgatctggagttatttaccggcgatgatcaggttaaagaaaccgtcgcctacgcccacgcgcatgatgtgaaagttgtcatgtccaaccatgacttccataaaacgccggaagccgaagaaatcattgcccgtctgcgcaaaatgcagtccttcgacgccgatattcctaagattgcgctgatgccgcaaagtaccagcgatgtgctgacgttgcttgccgcgaccctggagatgcaggagcagtatgccgatcgtccaatcatcacgatgtcaatggcaaaaactggcgtaatttctcgtctggctggtgaagtatttggctcggcggcaacttttggtgcggtaaaaaaggcctctgcaccagggcaaatctcggtaaatgatttgcgcacggtattaactattttacaccaggcataagcaataatatttcggcgggaacatcctcccccgccgaactaaaaaaatatatttaaccgtatttaataaaaatatttcgtgagtctctgtgcgctaattctccatctggcgtagggaaaatcacacctgaatcaggaattaacaatgaaacctgtaaaaccacctcgtattaatggacgagtgccggtcctgtcggcacaggaagcggtgaattatattcccgacgaagcaacactttgtgtgttaggcgctggcggcggtattctggaagccaccacgttaattacagctcttgctgataaatataaacagactcaaacgccacgtaatttatcgattattagtccgacagggcttggcgatcgcgccgaccgtggtattagtccgctggcgcaagaaggtctggtgaaatgggcattatgcggtcactggggacaatcgccgcgtatttctgatctcgcagaacaaaataaaattattgcttataactatccacaaggtgtacttacacaaaccttacgcgccgccgcagcccaccagcctggtattattagtgatattggcatcggaacatttgtcgatccacgccagcaaggcggcaaactgaatgaagtcactaaagaagacctgattaaactggtcgagtttgaaaacaaagaatatctctattacaaagcgatagcgccagatattgccttcattcgcgctaccacctgcgacagcgaaggctacgccacttttgaagatgaggtgatgtatctcgacgcattggttattgcccaggcggtgcacaataacggcggtattgtgatgatgcaggtgcagaaaatggttaagaaagccacgctgcatcctaaatctgtccgtattccgggttatctggtggatattgtggtggtcgatccggatcaaacccaactgtatggcggtgcgccggttaaccgctttatttctggtgacttcacccttgatgacagcaccaaacttagcctgcccctaaaccaacgtaaattagttgcacggcgcgcattattcgaaatgcgtaaaggcgcggtggggaatgtcggcgtcggtattgctgacggcattggcctggtcgcccgggaagaaggttgtgctgatgactttattctgacggtagaaacaggtccgattggcggaattacttcacagggtatcgcctttggcgcgaacgtgaatacccgcgccattctggatatgacgtcccagtttgatttttatcacggtggtggtctggatgtttgttatttgagttttgctgaagtcgaccagcacggtaacgtcggcgtgcataaattcaatggcaaaatcatgggcaccggtggatttattgatatcagtgccacttcgaagaaaatcgttttctgcggcacattaactgcgggcagtttaaaaacagaaattaccgacggcaaattaaatatcgtccaggaaggacgggtgaagaaatttattcgggaactaccggaaattactttcagcggaaaaatcgctctcgagcgagggctggatgttcgttatatcactgagcgcgcagtattcacgctgaaagaagacggcctgcatttaatcgaaatcgcccctggcgtcgatttacaaaaagatattctcgacaaaatggatttcaccccagtgatttcgccagaactcaaactgatggacgaaagattatttatcgatgcggcgatgggttttgtcctgcctgaagcggctcattaacaggagtatcacgatggatttttctttaactgaagaacaagaactgctgctggccagtattcgcgaactgattacgactaactttccggaagagtatttccgcacctgcgatcaaaacgggacatacccgcgtgaatttatgcgggcactggcggataacggtatttccatgcttggcgtgccggaagaatttggtggtatccctgcggattacgtcacccaaatgctggcgctgatggaagtgtcaaaatgcggtgccccggcatttttgatcaccaacggtcaatgtattcacagtatgcgccgtttcggttctgcagagcagctacgtaaaacggcggaaagcaccctggaaacgggtgatcccgcctatgccctggcattgacggaaccaggcgcaggctcagataacaacagcgccaccaccacttacacgcgtaaaaacggcaaggtttacatcaacggccagaaaacctttattaccggtgcgaaagagtacccgtatatgctggtgctggcgcgcgatccgcaaccgaaagatcccaaaaaagccttcaccctgtggtgggtcgactccagtaagcccggcattaagattaacccgctgcataaaatcggctggcatatgctcagcacctgcgaagtctatctcgacaacgtggaagttgaagagagcgacatggtgggcgaagaaggaatgggtttcctcaatgtgatgtataactttgagatggagcgcctgatcaacgccgcgcgcagcaccggctttgccgagtgtgcctttgaagatgccgcccgctatgccaaccagcgtatcgcttttggtaaacccattggtcataaccagatgatccaggaaaaactggcgctgatggcgattaagatcgacaacatgcgcaacatggtgttgaaagtggcatggcaagccgatcagcatcagtcactgcgcaccagcgcggcgctggcaaaactgtactgcgcacgtaccgcaatggaagttattgatgatgcgattcaaatcatgggcggtctgggctataccgatgaggcgcgcgtctctcgcttctggcgtgatgtccgttgtgaacgtatcggcggcggtacagacgaaattatgatttacgtagcgggtcggcagatcctgaaagattatcagaacaaataatctgcaggcggcgcagcttcttaacaaactgcgccgccagatttatccaacaagacttaccggttgaggaaattcagataagatttcttgttccgcaaaacagtttttaaattgcctgcggtaatcgctgggcgaacagccgacatggcgcaaaaacagtttggcaaagtgatcgacattttcataacccacacgccaggagatctctgcctgtgataattcagtattagtgagtgaccatttcgcttccgtcatacgccgttgaataacatagttaataggggaaatgcgatactctttggtaaattcatggcaaatataactgacgctggcacgaaactttttcgataactgctctaaagtgattttttcgcgatagttattattcagatagaaaagaatatcttttatcagaacatcttttttaatatatccctgctccgaacgataagcatttttaaagttttcgtagtaaagaattgctaacgtataggcaaaggcgtcccataacgaagatgtttggctatttttactttgcggcaaaatcacacttagctcattaaataaggttttaatgacttcttttccctgccctgcggcaattaccgggcaagaatgcggttgcagtagctgattttcctcagccccctgaaactgaaagccgtacagcgcacaagtacacgtcgttgccggatcgttaacgtcagaggccaccgcatgcagcctgccacgttctatcaccacaatgtcatcggcgtgcgcgacatataacgaagaatcgatggtaaaccttgctacccctttcttgacgtaaatcaactcagtttcattgtcatgaacgtgatgtccggactcccattttggatcatcgctaaatgcaaaacgtgaaagccgtggcgttttaccggcgacaaacagcgtttcgctggcgttatcaaaacagcgttgatacatgacaacctccctattccatgagcaagcaaaaacaatatatgccggataaaatacggcgtgtattgcggttatacaaccgcgtttagcgagagctaaacaagattatttacactgaatgcaagattgtacggtcatggaataactatattgccgcaaattgcacttttgttttagcgatcgcattttttttgcaagattgttggcaaggaaaacagcttgctccgtcgaaaaccccgcaccgctatcgcacactattttcagaccatttttaccttccatcggagatggttccgtatgcgactcacaggagaaatcatgaaaataataacctgctttaagctggtgcctgaagaacaggacattgttgtcactccagaatataccctgaatttcgacaatgccgacgccaaaatcagccagttcgatctcaatgccattgaagctgcaagccagattgcaacagatgacgatgagatagccgcgctgaccattggcggctcattgttgcagaactcgaaagtgcgtaaagacgtgctatcccgcgggccgcatagcctgtatttggtgcaggatgcgcaacttgaacatgcactgcctctcgataccgcaaaggcgctggcggcagcagttgaaaagatcggcttcgatttactgatctttggtgaaggttccggcgacctttatgcccagcaggttggcttgctggtcggagaaattctgcaacttccggtgattaatgcagtgagtgctattcagcgtcagggcaatacactggtgattgaacgcacgcttgaagatgatgttgaagttattgagctctctgttccagccgtgctctgcgtcacctccgatattaatatgccacgcattccttcgatgaaagccattctcggcgcgggtaaaaaaccgataaatcagtggcaggcaagtgacattggctggagccagagcgcgccacttgctgagctgaccggcattcgcgtaccgccgcaaacagaacgtaagcacatcattctcgataacgattcgccggaggccattgccgagctggcggaatatctgaagaaagccctgaactgaagcctacggagaagaaacgatgagtcaattaaacagcgtctgggtctttagcgataatcctgaacgttatgctgaactgtttggcggcgcgcagcaatggggccaacaggtgtatgccattgtacaaaataccgaccaggcgcaggcagttatgccttatggtccaaaatgtatttatgttcttgagcaaaatgatgcgctgcaacgtactgaaaattacgccgaaagcattgctgccctgctgaaagataaacatccttctatgttgctgctggccgcgacgaaacgcggtaaagctctggcagcacggttaagtgtgcaactgaatgcggcgctggtgaacgatgccactgcggtggatattgtcgatggtcacatttgcgccgaacaccggatgtatggcgggttagcgttcgcacaggaaaagatcaacagcccgctggcgatcattacccttgcacccggtgttcaggaaccgtgcaccagtgataccgctcatcagtgcccgacagaaacggtaccttatgttgccccgcgtcatgaaattctctgtcgcgaacgccgtgcgaaagcggcaagcagcgtggacctgagcaaagcaaaacgtgtggttggcgtcggtcgtggtctggcagcgcaggatgacctgaaaatggtccacgaactggcggcggtgctgaatgctgaagtcggctgttcacgtccaattgccgaaggcgagaactggatggagcgtgaacgttatatcggtgtctccggcgtgttgctgaaatccgatctctacctgacgctggggatctccgggcagatccagcatatggttggcggcaacggcgcaaaagtgattgtcgccatcaataaagataaaaatgcgccaatcttcaactatgccgactacggtctggtgggcgatatctacaaagtcgtccctgccctgattagccagttgagccgctaattcccctttcaaccacatctcccgctgtaaacgcagcgggaagggagcataacgcatgtcggatgacaaatttgatgccattgtggtcggtgcgggcgttgccggtagcgttgccgcactggtcatggcgcgagccgggctggatgtcctggtgatagaacgcggcgacagtgccggatgtaaaaacatgaccggcgggcgtctttatgcccacacacttgaagcgattattccaggctttgcagcatcagcgccggtagaacgcaaggtcacacgcgagaaaatctccttcttaaccgaagaaagcgccgttaccctcgactttcaccgcgagcaaccagatgttccgcaacacgcgtcttataccgtattgcgtaatcgtctggacccgtggttgatggaacaagccgagcaggcgggcgcgcagtttatcccgggcgtacgcgtcgatgcgctggttcgtgaaggaaacaaggtcactggcgtgcaggccggggatgatgttcttgaagcgaatgtggtgattctggctgatggcgttaactcgatgcttggccgctcgctgggaatggtttccgcttccgatccgcatcattacgctgttggtgttaaagaggttattggcctcacaccagaacagatcaacgatcgctttaatattacgggcgaggaaggtgccgcctggctgtttgccggttccccttctgacggcctgatgggtggcggattcctctataccaataaggattccatatcgttggggctggtttgtggattgggtgatatcgcccatgcgcaaaaaagcgtgccgcaaatgctggaagattttaaacaacaccccgccattcgcccgctgattagcggcggcaaactgcttgaatattccgcgcatatggtgccggaaggcggtctggcaatggtgccgcagctggttaacgatggcgtgatgatcgttggtgacgccgcaggcttctgcctgaatttgggttttacagttcgcggcatggatttagccattgcatcagctcaggctaccgccacaacagtgattgccgccaaagaacgcgcggatttctccgccagcagtctggcgcaatacaaacgtgagctggaacaaagttgtgttatgcgcgatatgcagcatttccgcaagatcccggcgctgatggaaaatccgcgcctgtttagtcagtatccgcgcatggtcgccgacatcatgaacgatatgttcaccattgacggcaaaccaaaccagccggtacgcaaaatgatcatgggacacgcgaaaaaaattgggctgatcaacttgctgaaagatggcattaagggagcaaccgcgctatgagccagaacgctacggttaacgtcgacatcaaattaggcgtcaataaattccatgttgatgagggccacccgcatatcattttggcggcaaatcccgatatcaatgaattccgtaaattaatgaaagcctgccctgccggactttataagcaggatgacgccggcaacattcattttgattctgccggttgtctggagtgcggcacctgtcgggtgctgtgcggcaacactattctcgaacagtggcaatatcccgcaggcaccttcggtattgattttcgctacggctaatcatgcatcccacaggcccgcatctcgggcctgatgttctgtctcgagagtccaaaatgaaagtgacattaacgtttaacgaacaacgtcgtgcggcgtatcgtcagcaagggctatggggcgatgcttcgctggccgattactggcagcagaccgctcgtgcgatgccagacaaaattgccgtggtcgataatcatggagcatcgtacacctatagcgcgctcgatcacgccgcgagctgtctggcaaactggatgttagcgaagggtattgaatcaggcgatcgcatcgcatttcaactgcctggctggtgtgaatttaccgttatctatcttgcctgcctgaaaatcggtgcggtttccgtaccgctgttgccttcctggcgggaagcagaactagtatgggtgctcaataagtgtcaggcaaaaatgttctttgctccgacgttgtttaaacaaacgcgtccggtagatttaatcctgccgctgcaaaatcagcttccacaactacaacaacttgtcggcgtggacaaactggctcccgccacctctgctctctcattaagtcagattatcgccgacaatactcctctaaccacggcgataacggtccacggcgatgaattagccgcggtgctgtttacctccggaaccgagggtctgccaaagggcgtgatgctaacgcataacaatattctcgccagtgagcgggcttattgcgcgcggttgaatctgacctggcaggatgtctttatgatgcctgcgccacttggtcatgcaacgggctttctgcatggcgtaacggcaccattcttaattggcgctcgcagcgtgttgttagatattttcactcctgatgcgtgtctcgcgctgcttgagcagcagcgttgcacctgtatgctcggcgcaacgccgtttgtctatgatcttttgaatttactggagaaacaacccgctgacctttcagcgctgcgcttctttctttgcggcgggaccacaatccccaaaaaagtggcgcgtgaatgccagcagcgcggcattaaattattaagtgtttatggttccacagaaagttcgccgcacgcagtggtgaatctcgacgatcctttgtcgcgctttatgcacaccgatggttacgctgccgcaggtgttgagattaaagtggtcgatgacgcacgcaagaccttaccgccaggttgcgaaggtgaagaagcctcgcgtggccccaatgtgtttatggggtattttgatgaacctgaattaaccgcccgtgccctggatgaagaaggctggtattacagcggcgatctctgctgcatggatgaggccggctatataaaaataaccgggcgcaagaaagatattattgtccgcggcggcgaaaatattagcagccgtgaagtagaagatattttattgcagcatcctaaaattcacgatgcctgtgtggttgcgatgcccgatgaacgtttaggtgaacgctcatgcgcttatgtcgtgctgaaagcaccgcatcattcattatcgctggaagaggtggtggctttttttagccgtaaacgggtcgcgaaatataaatatcctgaacatatcgtggtaatcgaaaaactaccgcgcactgcctcaggtaaaatacaaaagtttttgttaaggaaagatattatgcggagattaactcaggatgtctgtgaagagattgaataagtttcatcttcggggatcacataaacccggcgactgaacgccgccggggatttattttatttcttcagttcagccaggcttaaccaggtttgcaccacggtatccgggttcagagacaggctatcgatcccttcttccatcaaccatgcggcaaagtcttcgtggtcggacgggccctgaccgcaaatcccgacatatttgccctgtttcttcgcggcacgaatcgccatcgacagcagtgctttcaccgcatcgttgcgctcatcgaacagttcagacaccactccggagtcacggtccagaccgagcgccagctgtgtcatgtcgtttgagccaattgagaagccgtcgaaatattcgaggaactgctctgccagcaaggcgttggacggaatttcacacatcatgatgattttcagcccgttctcaccacgtttcagcccctgacgcgccaattcgtcaaccaccgctttcgcctgatctacggtacgcacgaacgggatcatgatctcaacgttggtcagtcccatgtcgttgcgcacacgtttcactgcttcacactccagcgcaaagcagtcgcggaagctgtcggaaacatagcggcccgcgccacggaagccgagcatcgggttctcttcatctggctcgtaacgctcaccaccgaccaggttggcatattcgttcgatttaaaatcagagagacggacaatgacgcgcttcggataaaacgcggcacccagcgtcgcgatcccttcagtcagacgcccaacgtaaaattcacgcggagaatcaaaacctttcatcatctcgcggatttcgttttgcaactgcggttcctgatcgtcaaactcaagcagtgcgcgtgggtggacgccaatcatacggttgatgataaattccagacgcgcaaggcccacgccttcgttcggcaggcaggcgaagtcgaaagcacggtccgggttaccgacgttcatcatcaccttcaacggcagatcaggcatcgtttctacgctggagcttttcacgctaaattccagcaactccgcatagacgtaaccggtatcaccttcggcacaagaaacagtgacgttctcaccgtctttcatccgttctgttgcatcaccacagcccactaccgccggaatgccgagttcacgagcgatgatcgccgcgtgacaggtacgaccgccacgattggtgacgatggcagatgccttcttcatgatcggttcccagtccgggtcggtcatgtcagtaaccagcacgtcgccaggttcgatgcggttcatttcgctgatgtcatggatgactttcaccggacccgcgccgatgcgatgaccgatagcacggccttcggcgataatcttaccctgtgaatgcagcgtataacgctccatgatctgaccgcgtgagcgcacggtttccggacgcgcctgcacaatgaacagtttaccggtgtggccatctttcgcccactcaatatccattgggcgaccgtagtgtttctcaatttgtacggcctgttttgcaagttcctgcacttcttcgttggtcagcgagaagatgtcacgctgttcctgcggtacgtcttcgattttaacctgcttgccgtgctcctgggtcggcgcgtaaaccatgcggatttttttcgaccccatggtgcggcgcacgatagccgggcgattcgccgccagtgtcggtttgtgcacgtaaaactcatccgggttaaccgcaccctgcacgaccatttcaccaaggccccatgcggaagtgataaacaccacctggtcaaagccggattcggtatcaatggagaacatcacgccagaagatgcgaggtcggagcgcaccatccgctgaacaccggcggagagcgccacgccacggtgatcgtaaccctggtgcacacgataagagatggcgcgatcgttaaacagagaagcaaatacatgtttcactgccacgagaacggcgtcaaaaccctgaacgttgaggaaagtttcctgctgaccggcaaaagaagcgtccggcatatcttctgcggtggcggaggaacgcaccgcaaacgaggcgttttcgtcatcggcggaaagctgtgcataggcttcgcggatggcgttttccagctcaggctggaagggagtgtcgataatccactggcggatttgcgcgcccgctttcgcaagctgggtaacatcgtcaatatccgttttatccagcagttcataaatgcgctggtttacgccgctttggtccagaaactggttaaacgcgtcggcggttgtggcaaaaccattcggaacggaaacacccattccggaaaggttagtaatcatttcacccagggaggcatttttgcccccaaccctgtctacatcattcatgccgagttggttataccaaagcaccagcggtgacgagccattgttggacatcgaacaatccttttgtgataaatgaacggtttgagaaacacatttctgcgcatttatctttgcatatttaaccggatgaaaaaaacggtgaatcgttcaagcaaatatatttttttactttttaagactgatcccagcgttgcgcaaacctgctctattcgacaatttccacataaaccatcggtataaacgaaaccataaaaatgaaatgctgttttcataaataataaaattgaaggttcattttataaaccagacataacattctacgcttctgtgcgtttttaatttatgctttcatagaattatgtctgcatcacgggaagaacaaaatggataatgctgttgatcgccacgttttttatatttctgatggtacggcaataactgcggaggtattaggacacgcagtaatgtcacaatttcccgtcactatcagcagcattacgctgccgtttgtcgaaaatgagagccgtgcacgggcagtgaaggatcagattgacgcaatttatcaccagacaggtgtgcgcccgctggtcttctactccatcgtgttgccggagattcgcgccatcatcttggaaagtgagggcttttgccaggatatcgttcaggcgctggttgccccgctacaacaagagatgaaactggatccaacgccgattgctcaccgaacccacggccttaaccctaataatctcaataaatatgatgcgcgcattgcggcgattgattacaccctcgcccacgatgacggcatttcgttgcgcaatctggaccaggctcaggtgatcctgctcggcgtttctcgctgtggtaaaacccccaccagtctgtatctggcaatgcagtttggtatccgcgcggcaaactacccctttattgccgacgatatggataatctggtgctacccgcgtcgctcaaaccgcttcagcataaattgttcggcctgactatcgacccggaacgtctggcggcgattcgcgaagaacgtcgggagaacagtcgctatgcctcgcttcgtcagtgcaggatggaagtcgcggaagtagaagccttgtaccgtaaaaatcagatcccgtggattaacagtaccaattattcggtagaagagattgccaccaagatcctcgatatcatgggccttagccgccgaatgtactagagaactagtgcattagcttatttttttgttatcatgctaaccacccggcgaggtgtgacacacctcgcacttgaaatcagctgcgattggtttatcgtgatgcgcatcacttcccggtagtcctgccgtagaagcaacaaatttctgagacttgtaatgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactgaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaaggactaatctccgatccggatttaaacggcagctatcgggtaaatcacggtctggagctggcgcgcaaattacttttacaggtaaatgagctgggcgtccctaccgcgactgagttcctcgatatggtgaccggtcagtttattgctgatttaatcagttggggtgcgattggcgcacgtactaccgaaagtcagatccaccgtgaaatggcttcggcactctcctgtccggtaggttttaaaaatggtaccgatggcaacacgcggattgctgtggatgctatccgcgctgcccgcgccagccatatgttcctctcaccagacaaaaatggtcagatgaccatctatcagaccagcggcaacccgtatggccacattattatgcgtggcggcaaaaaaccgaattaccatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcggtcagccgctcacttacggtcaatcgattaccgacccgtgtctgggctgggaagataccgaacgcctggtcgaaaaactcgcctctgcggtagatacccgcttctgaatgcgtgcccattcctgacggaatgggcatttctgcgcaacttgttgtcttctcaacacattactgcttgctctggcccgctataatattgataataagaatcattgttatatcaattattattaatttttatgcgttatacggatagcagaaaactcacgcctgaaacggatgccaatcacaagaccgcttccccgcagcccatccggcgaattaccagccagacactgttaggtccggatggcaaactgattatcgatcatgacgggcaagaatatctgctccgtaaaactcaggctggcaagctgctgttgaccaagtagcctttaactcgagcagctgacttccagccgtttaccccagtcaggtggacgactgacgtagtcatcatctctgtcgctgaaaggatttcgcaacgcctcatgcaggcggtgcaattccgtcatatcacccttttctgccgcttcaatcgcccgttgcgccaaccagttgcgcaacaccagagctgggttaacgctttgcatcagctgctgacgctcactatcggtaacctcgtcttgttgcaaacgtacccgataacgggcaaaccagtcatcaaatgccgcacgatcgataaactcatcacgtagcggtgacgccgcgctgtactgctcggtcagactcagcatgcggaatgtgcgggtataatcgctgcgctctcgcgccatcagactgaataattcattcagtagcgcgttatcctctttttgctccgtcatgaagcccagtttctgccgcatccgttgtccataatgcgtcaacaaaacctgctgatagctgtccagggcctcattcagggcatctacggcaacaaatggtgacaatgtctgcgccagacgctgtaaattccacaacgcgacagcaggttgattatcaaagctataacgcccttgatgatccgagtgattacaaataaaaccgggttcgtaatcatcaagaaaaccaaacggcccgtaatcaagcgtcagccccagcagcgacatgttgtcggtattcatcaccccatgagcaaagccgaccgtctgccattgggcaattagcgatgcggtacgtgcgacaacatcgctaaaccagagacggtatttgtcctcatcatcttcaagatgtgaccagtaatgacgaatggcaaagtcagccaactgacgaaccttttccggctcgcggcgatagtaaaaatgttcgaaatgaccaaagcgcagatgacttggtgccacacgcatcagcatcgcgcctggctccaccgtttcccgatacactggcgaatcgctggtgacgatacttaacgcgcgggtcgtcggaatgcccagataatgcatcgcctcactggcgagactttctcgtatcgtcgaacgtaaaaccgcccgtccatcacccattcgcgaataaggcgtcaggccagcacctttcagatgccagtccattgtagtgccatcagcaagccgttgttcgccgagtaaaatgccgcgcccatcacccagttggcccgcccagacgccgaactgatgaccactgtaaacctgcgccagtggtgacataccaggcagtagggtttcgccgccccagacacctgcgtcatttttaaacagcgacgatggaatactcagcgtgttagcgagttcggtattatgccaaatcagccgggcattatttaaaggcgtaggggaaagtgctgtataggttcctggcaattcatcgcgccagcgggtaacaaaagacagggtcatagatcctcctgtttgatagtgtagacggttactctcgtcttaaacaccagcaaacaggagggttatcgctgaaccaacgtcgttatctgatttatgggaacggcaggccacaggcatccctggagagcatggaaatcgaagggggtaatctgtgccattatttctggcgtatcaatgccccccgcgatgatgcaattgcaacatggggaaatttgcgcctggatcgcacgaataaacggttcgaaggagcggtgcgtgatttgttgctgaataaaacttttatccagcatgacgcgggtgaaaagaccatcaaaaaccgctttcattgtgctattgcctgcgcccaaattacctaacacaaggggatacatttgcgataaggacaaaagatcgcgattatcttttccttcatcgagatgcgggtaattctcattaatcaacagttcaataaacggatattttaatagttcgcctgcgtaattatccctgtctaataataaagtagccacttgtggcgttaaattaagccaggcaaagagtttatgttgaataaaaaagtgttggcatgattttagtaattccaactgctctgaaaataattgccaatgttgctccgcggtaagttgcgctataacccgactcgtcgggatacgaaccgtaccatcttcactggagaaatgggtaattaactcaacgccgacaaggtcttgctggttatctcttatcggcaggaaatagcaatcagaatgataaagattctccaaaaaaatcttcatggtaaccgtccctctcgaaggatgtttttcagtatccggctaaaagggatgaggccataagacataacaattacagaaggagtaactttcatttgttccatgttaaccactttttcaggggtcctttttttagattatcctgattataaacgaataatccatttacggaatttttgtctgcaaaatactactgtattctggagtaaatggacggcgatgtatcatcgccgtccatttttcgacatactagattcgtctcgcctgccagaaatttttctgccaatagacattatcaagtgaggaacgcatcactcccttgctggtagaggcgtggataaattggttgttggtatcgtaaatacctacatgcaaaccattttgtccggagcccgttttgaaaaagaccaggtcaccaggcagcaactcgtctttatcaatttgcgtgccgatagaggcttgttctttggtttctcggggcagctgcaaatcgaaacgatcgcgcatcgtcacaaccacaaatcccgaacagtccacaccgcgccgcgtcatgccaccataacgatacggcgtgccatgccagctctgtagctggtcgttcaaaccggcaataacggtaatcgaatcagaaagtctggcatttggcggcggtgctttatggtggctacacccggccagaaacagtgctgtgatcaaaataaggcagaaacgcattccgtacggttcctctgttttttattcttgcattaatttagcgtcgtaattacccgattttcaagatactaatgaaatcaaatggtcgaaatcagcattcggtgaccttcgatatccagacggcgaaaattcatcccataggcctgcgccagatttggcggcgtgagcacctcttccctgcgtccactggccagcatttttccaccttttagcaaccatgcccgatgcgcatgacgcaatgtgtggttgagatcgtgactgctcatcacaatcgccagtccttgctgacacagcgcgctcagaattttgtctaacgcactttgttgcgcaacatcaagactgttcatcggctcatcaagaagcagcaattggcctgcgggattggcttgtggtgtgatttgcaacaccaccgcagcaagacgtacgcgttgccattcaccgccggaaagttgattggtgctccgtccgagtttgtcatcaagagccagcgcccctgcgacatcattcagtagttcggtacgcgttttatcgtgctgatgcagtgtcaggtagtgccagaccggcattgcaaacggcggcgtctgctgttgtgaaagataggcgcgatgcagcgcgagttttgttgcggaccatgcttccagtggttgccccgcgaactgaatgcttcccttaccgctggtcattccggccattcgcgccagtaaggtactcttacccgcgccattcggccccaccagatgcaggatctcccctgcccgaacctcgccagaaagcggcccaaggcgggttgattccgcaacatcctgtagctgcatcacaatagacattatttcgccaacgccagtttaatgctttccatcacaatgggatcttccggcgtcatatccggggaaaaacgctggattaccaatccgtccctgccaactaaaaatttctcaaaattccataaaatatcatcagggtacagcggtgcacgacctttgctgaccatacgggcatagaatccgctctcttccggcgcgactgcggtcggcgctgcggcaatcaatttttgatacagcggatggcgtccttcgccattaacttcaatcttactgaacatcgggaacgtcaccccccatgtagtggtgcagtaagttttaatctcttcatcgctgcccggttcttgctccagaaactggttgcacgggaatcccagcaccacaaaaccacgatcggcccaggctttctgaatattctccaactgctcatattgcggcgttaagccacactttgaggcgacattgacaatcaacagcacattaccggcgtacttctccagcgtggtcacttcaccgtcgatatctttcactacggtcgtcagaatggaatcttgcatcgtttctcctgggtgtggtcagtaaaaatcttagcttttaatcatagaccgtctttttgcggctaacgtcctgcttttaacaataaccagataaacaccggcgcacccaacgttgcggtgaccacgccaataggcagctctgcggcagctaatgccaggcgcgctacaacatcagccagcagcaatgcgctcgcccctgccagcgcgcagccgggaagtaatacgcgatgatcggttaaaccacataaccggagaatatgggggatcaccagaccaataaagccgatagcacccgccagcgccacactgacgccaaccatccagccggtcgctgccaccagcacattgcgccagaaccacaggggtaaacccagttgccgcgccgagatctcgccaagtgctaacatattcatcggcctggactgacaacagatccacaacaacacggggatcaatgccagcatcagccagctttgccgccagtctacgccgccaaaaccgcccatcatccagtacatcagctgacgtaaatcaacagaggtggaaaagtagatagcccacgtcattagtgcgctacagataatccctaatgcaacgccagccagcaataaccgactggtcgaaagatgacgacgggcgaaacgtaagagtattaaagtgatgataagcgcgccagcaatcgcacacagccctagtgcccagtttgggagttgcccttgcccaagcaacaccgcggcgataagccctacgcctgcgccgttagagacgccaagtagtccaggttctgccagaggattttcaaacaacgcctgcattactgcgccggatatagccagcgccgcaccaaccagcaatacagccagcgtacgtggcaggcgaatttgccagacgaacagttcgccacgaggagtagaccagtcaccgggcgaaatccattgttcaccggcgcaaaggcttaagagaagcgccagcagcatcaaaactgacaggcataataaccagcgaatattttgtcgctgttgttggcgggcaagtgtcagcatggtatccgttctgctgaagtgtcatggcgttgattttacggtgactcttcgacagtgaaaagaaaaaaggccgcagagcggcctttttagttagatcagattactcgtctttgggcgaagcgttttcgacccggctttttaacttctgcccgggtctgaaggtcaccacgcgccgtgctgtaatgggaatatcctcgcccgttttcgggttacgtcccgggcgttgattcttatcacgcagatcgaagttaccaaaaccagagagtttcacctgttcgccgttttccagagcgcgacggatctcttcgaaaaacagttcaaccagttctttggcatcccgcttgctaagcccaagcttatcaaacagatattctgacatttcagcttttgtaagcgccataggttcaatccctcaatgatgcctggaatcgctcttttaatgcctctacacatttggcgacggtagcggcaatctcctcttcttcgagtgtacggctggtatcttgcaggatcaggcttatggcgaggctcttatacccctccgcaacacccttaccgcggtacacgtcaaataagtttacgccaactacctgatttacgccaactttcttacattcggataaaatatccgctgcgggaacgttttctgcgaccaccaccgcgatgtcacgacggttcgccggaaagcgagaaatttcgcgcgcctgaggcaccacgcggtctgcgagcttgttccactccagttcgaacaccagagtgcgaccgttaagatccagtttacgttccagttcaggatgaacaaccccaacaaaaccaatacgttcacctttcagataaatcgctgcggattgccccggatgcagtgccggattcgcttctgcacggaactcaacctcattcagtttaccggtcaggtcgagaacggattcaagatcgcctttcaaatcatagaaatcaacggtctcttttgccaggttccagtgctcttcgtaacggttaccgcaaatcacaccggctaacatcagatcctgacgaatgcccaacggtgcctgagtatctggtacgaaacgcagaccactttcgaaaatgcgcacacggttctgctgacggttctggttgtacaccacggttgccagcaggccggtccacagggaaagacgcattgctgacatttcaacggaaatagggcttggcagcagtaaggcttcaacgcctggatggatcatctgctgcactttcggatcaacgaagctgtaggtgatcacttcctgatagcctttgtcgttgagcagcgttttcacgcgcttgagcgacaggtcagcttcacggtgagtacccataatcaggcttgcctgtaccggctcatccgggatgttgttgtagccgtaaacacgcgcgacttcttcgaccagatcttcttcaatctccatgtcgaaacgccagctcggcgcaactgcctgccactcgtctttgccttcggtcacttcgcagccgagacgacgcagaatgtcagtgacctgctcatcggcaatatgatggccaatcaggcgatccagtttgctgcgacgcaaagtgatggttgcacgtttcggcagcgttgcttcgttggtgatatcaattaccggaccagcctcaccaccacagatgtcgatcagcagacgggtcgcacgttccatcgctttgtgctgcagtgccggatcaacgccacgctcataacggtgagacgcatcggtatgcaggccatgacgacgagcacgaccggtgatagatagtgggctgaagaaagcacattccaacaggacgttttgcgtttcttcatttacgccagaatgttcgccaccaaagatgccgcccatcgccagcgccttgttgtggtcggcgatgaccagggtgtcagcgttcagcttcgcttcggtaccgtcgagcagtaccagcgtttcgccctctttcgccatccgcaccacaatgccgccttcaatgcgatctttatcgaaagcgtgcatcggctggcccagttcgagcagcacatagttggtgacgtcaacaactgcatcgatagaacggatcccgcaacgacgcagtttttctttcatccacagcggagttggcgctttaacattaatgccttttaccacacggccaagataacgcgggcaggcttccggcgcttcgactgtaatcggcagcgtgtcgtcgatggtcgcaccaaccggaacgatttccggttcaaccagcggcagctggttcagcacggcaacgtcacgcgcaacaccaatgatacctaagcagtcggcacggtttggtgtcacgctgatttcgatggtgttgtcatcgagtttcaggtattcgcggatgtcggtgccaatcggcgcatctgcaggcagctcgattatgccgttatgatcgtcagaaattcccagctcagaaaaggagcacagcatcccttcagacggttcgccacgaagtttcgccgctttaattttgaaatcgcccggcaaaacagcaccaatggtcgctaccgccacacgcaggccctgacggcagtttggcgcaccgcagacgatgtccagcaggcgatcgccgccgacattcacttttgtcacacgcagtttgtcagcgttcggatgctgcgcacactcaaccacttcaccaacgaccacgccgtggaagctaccggcaaccggttctacaccgtcaacttccaggcccgccatagtgatttgatttgccagcgcatcgctatcaatcgccgggttcacccattcgcgtaaccacagttcactgaatttcataatctattcctgccttatttaaactgtttgaggaaacgcagatcgttttcgaagaatgaacgcaggtcggtgacgccgtaacgcaacatggtcagacgctccatccccatcccgaaggcgaaaccagagtaaacttccgggtcgatgccaacgttacgcagtacgttcggatgtaccattccgcagcccagtacttccagccatttaccgtttttacccatgacgtccacttctgcagaaggttcggtaaacgggaagtaggaaggacggaagcggatctgcaaatcttcctcaaagaagttacgcaggaagtcgtgcagcgtgcctttcaggttggtaaagctgatgttggtatcaacaatcagaccttccatctgatggaacatcggcgtgtgagtctggtcgtagtcgttacgataaacgcggccaggcgcgatgatacgaatcggtggctgctgagctttcatggtgcggatctgcacgccagaggtctgggtacgcagcaggcgggtagcgtcaaaccagaaagtgtcgtggtcagcacgcgccgggtggtgaccaggaatgttcagagcatcgaagttatgataatcgtcttcgatttccggcccggttgccacggtaaagccaagctcaccgaagaaactttcgatacggtcgatggtacgggtcaccggatgcagaccgccgttttcaatacgacgccccggcagggagacatcaatcgtttccgccgccagacgcgcattcagcgctgcgctttccagttccgctttacgtgcattcagcgcctgctgaacctgctctttcgcttcgttgataaccgcaccggctgccgggcgttcttctggcggcagctcacgcagggtcgtcatctgaagggttaagtgcccttttttacccaaatattcgacgcgcacattgtctaacgcggcaacatctgacgcctggctaatggccgccttcgcactggcaaccagttctgcgagatgtgacatggttttcctcattgtgtcagtggtgacactggttcgttggacttaattttttcaaaacgcgcatacaaaaaaagcctccactgggaggctttcaggcgctgttttccgtttctcttctcacgcgctagcctcctggagtcaggagctaaagtaaaaaaagaagcggaaaatagcagcattcattgcttgcgttaccttttggtacttttcaaaagacctttattgaaaaggctacggcgataaaagtcaatgttttgatggcgttgaaacgaaaagagggagactagctccctctttcaactggcttatgccagagctgctttcgctttttcaaccagagcggtgaacgctactttgtcgaatactgcgatatcagccaggatcttacggtcgatttcaacagaggcttttttcaggccattgatgaatttgctgtaagaaataccgttctgacgtgctgctgcgttgatacgcgcaatccacagttgacggaactgacgcttacgttgacgacggtcacggtaagcatactgaccagctttgataacagcctggaaggcaacgcggtatacgcgagaacgcgcaccgtagtagcctttagcttgtttcaaaattttcttgtgacgtgcgcgtgcaataacaccacgttttacgcgagccatatgtgctctcctgtatctatattctaattaaaaagttaaaaacgttaacggcttatgcgtacggcaggcacgcgattaccaggcccagatcgcctttggaaaccatggctttcggacgcaggtgacgtttacgtttggtcgcttttttggtcagaatgtgacgcaggttagcgtgcttgtgcttaaaaccacctttaccggtttttttgaagcgcttagcagcaccgcgtacggtcttaatttttggcattttaataacttccacttcgcattgttaataaacgaaacaaaggcgaacaatgcctgtgaagcccaaaggctccacagacagtgctacttgaaggccttactgtttcttcttaggagcgagcaccatgatcatctggcggccttcgatcttcgttgggaaggattcgaccactgccagttcttgcaaatcgtctttcacgcgattaagcacttccataccgatttgctggtgcgccatctcacgaccacggaaacgcagcgtgattttggctttatcaccctcttcgagaaagcgaatcaggctgcggagttttacctgatagtcgccttcatctgtaccaggacggaatttaatttccttaacctggataactttttgctttttcttctgttccttagaagacttgctcttttcatagaggaatttgccgtaatccattatacgacaaaccggcggctcggcgttagggctgatctcgactaagtctactccggcttcttctgctttctccagagcttctctcagactcacaataccaagctgctcgccttccagacctgttaagcgaacttcctgggcgcgaatttcgccattgatacggttagggcgcgccgtttgaactcgttttccgcctttaataccttattcctccaattgtttaagactgcggctgcgaatctcttgttgcagcttctcgatcacttcatttacgtccatgcttcccaggtctttaccacggcgggtgcgaacggcaactttgcctgattccacctctttatcaccacagaccagcatatacgggacgcgacgcaaagtgtgctcgcggattttaaagccaatcttctcatttctcaagtctgctttaacacgaatgcccgcatttgatagtttttgcgtcaattcgttaacgtattcagactgtgaatcggtaatattcatgataacaacctgaaccggcgcaagccaggtcgggaagaaaccagcgaattcttcggtcaggataccgatgaaacgttccatcgaccccagaattgcgcggtgaatcataaccggtaccttacgctcgttgtcttcgcccacataggaggcgctcagacgagacggcaaggagaagtccagctgtactgtaccgcactgccatgcacgatcgaggcagtcatacagggtaaattcaattttcggaccgtagaaagcgccttcacccagttgatattcaaacgggatgttgttttcttccagcgcaaccgccaggtccgcctcagcacgatcccacatttcgtcgctgccaatacgtttttcaggacgagtggagagtttgacgacgatcttctcgaagccaaaagtgctgtacatatcatagactaaacggatacatccgttaacttcatcgcgaatttgttcttcagtacagaagatatgcgcgtcatcctgggtaaaaccacgtacacgcatcaggccatgcagcgaacctgacggctcgttacggtggcagctaccaaactcggccatacgcagcggcagatcgcgataagacttcagcccctggttgaaaatttgtacgtgacccgggcagttcatcggcttaatgcagtattcacggttctcagaagacgtggtgaacattgcatctttgtagttgtcccagtgaccggttttttcccacagaacacggtccatcatgaacggacctttaacttcctgatactggtactctttcagtttagaacgaacaaacacttccagttcacggaagatggtccagccatcgttgtgccagaagaccatacccggtgcttcttcctgcatatggtacaggtcgagctgtttaccgattttacggtggtcgcgtttcgcggcttcttccaggcgctgcaggtaagcgttaagcgcttttttgtctgcccacgccgtaccgtaaatacgttgcaacattttgttgttgctgtcgccacgccagtaagcccctgccgttttcattagtttgaaatgatggcagaaacgcatgttcggtacgtgcggaccgcggcacatatcgacatattcttcatggaagtacagacctggcttgtcatcatgggcgatgttttcgtcaagaatggagactttgtagctctccccacggttggcgaaagtttcacgcgcttcgtgccagctgactttcttcttaatgacgtcgtagtttttctcagcaagctcatgcatccgcttctcgagtgcttcgacatcttcctgggttaacgtgcggtcaagatcaacgtcgtaataaaaaccgttgtcaataaccgggccgattgccattttggtatgcggccaaagttgtttaatcgcgtgccctaacaggtgcgcacaggagtgacgaatgatctccagaccttcttcgtctttggcggtaatgatcgacagttgtgcgtcgttttcaatcagatcgcaagcatcaaccagttcgccattaacgcgccctgcgatacaggctttcgccagacctggaccaatgtccagcgcaacatccatggggcttacagcgtggtcgtaatggcgttggctgccatcaggaagagttataacaggcattttatatccttatttgcagtggtgacccacacgaaagatcacatacaaagaaaaatttgtttattaacagttcattgcgaaaccatctagccaacaaatgctaaattggttcgcaatcaggtacacaaatgaaagacattaacctctcaccttccacccggttgaacgatgttaacactaaaaaaagggagattgtacctttccgtttcacattgattcgattcgcaattcgtttgtagtgagtacaccagcaaaacgcttaaagaaccactgataacatcacggagcgtctgaaaggtttactgcgagcggatttgcagcagcataaactgaatccagcaaagttcgttgcgtgatttggcggtactatttaaacgatcataagattaatgacgaagtggtcatatcacaatgataaaagtgacacaattcttatagcaatttttcgtgcacatttcgttctggcgataataattaatcatcatcctcaaaacctccagacatatataaggcgaatagattatgagtcaaaacgacattattatcagaactcattataagtctcctcatagaatgcacatcgatagcgacataccaacgccttcatcagagcctattaatcaatttgcgcgccaactcatcaccctacttgatacctctgacttaagttcgatgctgtcatactgtgttactcaggaatttaccgcaaactgtcgaaaaatatcacaaaattgttattccactgccctttttaccattaactttgccacttcacccatccatgcagaaaatatactcattacattacactataaaaaagaaatcatttccttattactggaaaccacgcctattaaagctaaccatttgcgaagcatactggattatattgaacaggaacagttaactgccgaaaatcgtaaccattgtatgaaactgtctaaaaaaatccatagagaaaaaactatacaaccaacagtaaatctcaatggtagtgcatttttttcgcaatctccttctgacgctattttttgtcgccatctgtcattgcaatacgcacttgattcactgagaaatggaaaaggcaaagtcaatctgattaaacattactcctccgttgaatccatacagcagcatgttcccttagtccgggacgcggagttcagatcattacttcgccatcctcctgcagggagtcgcgttatcgcgagtaaggattttggcttcgctttagatattttcttctgtcgaatgatggcaaacaatgtcagtcatatgtccgcgattttatatatagacaatcatactttgtcagtaaggctacgaataaagcagtcagcgtatgggcaattaaattatgttgtgtccgtttacgacccgaacgataccaacgttgccgtcagaggcacccacaggacagcacggggctttctctcgctcgataagttcatcagttcaggtcccgatgctcagacctgggctgataggtatgttcgcaactgtgcaattgcttttctgcccctattacctgagggagttccaggggctattttcgcgggtattgcatcacgaatgccatttgcccctatacatccatcggcaatgttgttaataatggccacaggccagactcaacagcttattacattattcaaacagttacccatactccctgaaaaagaaatcattgaaataataactgcgcagaatagcgttggtacacctgctttatttctggctatgatgaacggacatactgacaacgtaaaaatatttatgcaagaaattcagtcactggtagataatcatatcattcatgaagataatctggttaaattactgcaaactaaaagtgctaacgaaacacctggactctatatctccatgttgtatggattcgatgaaataatcgatatctttctgaatgcattaaccactccaataacacaagagcttttaagcaaaaaaatggtgatggatattttagcaatgaaaacacgtgatggtgagccaggattatatgccgcaatggaaaataatcaccctttgtgtgtcacacggttcctctctaaagtttatggaatcgctgttaaatataacctcagcaaaattaacatcatggatttattaaaaggcgcaacagcacatggaacccctgctttatacatcgccatgagcaagggtaataaagacgtcgtgttatcttatatatcaacgctgggtacttttgcaaaaaaatattcttttagtcaatgtcagttattcacattgttggccgctaaaaatcatgacaacatgtcagctgttcatatagccattcatcataatcattataaaactgtagaaacatattatgctgctataaacgtaatcagccaaagcctgagttttagtgctgatgaactaaagacgtatttataaccagacatttatatatcgatacataattttatttttttcataaaccgcaaaaacagtgatcaggtgtacaacgccacccgacggctgtaataacaaaaaatcccttgatgcctgtcccttttgttacactccgttatcacgcacaagagatatgcaggacactggtatgccgactaaacgctttgataaaaaacactggaagatggtggtggtgctactggcaatctgtggcgctatgttgttgctacgttgggcagcaatgatttggggctgagcagtgacaaacgaagacagccagaccgcataacacggtccggcagataattttacatgctgtagcccagcgataaggttgtccgacgatcggtatgttccggtgcagactctggaggttcagagttccatgtgacgttgtaagccaccttcagtccaaaatgttcattaatagcaacatttaatgcgctttcggagttcagcgttgtgtcttccgcgccaaagacggaaacaccctgcgtaaatttagcgttgtcagtcaactgccatgcataagccccggaggcataacccagcggctgggtttcactggcattatcggtatatttgtcgtaacgcacacctggaccgaattcaaagcggaaactgtgtaccgggccattcaaaaactggcgaccataacccgcggtcaacacatcgcgctctcgatagccgttataacggtctgtcagccagcttgcctgcccaaataaatagtcataatcagttaaattaaaacggctacgcccgcccgccgcatatttttctgaagaacgctcatcattagaagaagtattactggcgttcccccacagcgaccaggcagtggtttgtccataccaggtcatggtggtgtcagccgtaagtgaggagcttttcgtattgcctgattgtgcaagatatcctgcgttcagattaccttcgaaaggttttttagcgctggcaggatcgtccatgacagtaaaaacggaatcatcggcagctgcattcagtgacgcaaacatgccccccgccaacataacgatggcaggaactgtcttcaaaagcttcatttatcaagagtccgtacaacaaaaaaagagaccttcgcggtcccggaaactttcttaaggatcaaagattagcgtccctggaaaggtaacgaattataaaaaggcgcgaataacttagcaatgtattcttatttcattttttgaataagcatgtggcgaaaacaaatttttatttatatatatttatctgcaaaattttaaataaagctctaataaatcatattgttaatttcttcactttccgctgattcggtgccagactgaaatcagcctataggaggaaatgatggtacgtatctatacgttgacacttgcgccctctctcgatagcgcaacaattaccccgcaaatttatcccgaaggaaagctgcgctgtaccgcaccagtattcgaacccggaggcggcggcatcaacgtcgcccgcgccattgcccatcttggaggcagtgccacagcgatcttcccggcgggtggtgcgaccggcgaacatctggtttcactgttggcagatgaaaatgtccccgtcgctactgtagaagccaaagactggacccggcagaatttacacgtacatgtggaagcaagcggtgagcagtatcgttttgttatgccaggcgcggcattaaatgaagatgagtttcgccagcttgaagagcaagttctggaaattgaatccggggccattctggtcataagcggaagcctgccgccaggtgtgaagctggaaaaattaacccaactgatttccgctgcgcaaaaacaagggattcgctgcatcgtcgacagttctggcgaagcgttaagtgcagcactggcgattggtaatatcgagttggttaagcctaaccaaaaagaactcagtgcgctagtgaatcgcgaactcacccagccagacgatgtccgcaaagccgcgcaggaaatcgttaatagcggcaaggccaaacgagttgtcgtttccctgggtccacaaggggcgctgggcgttgatagtgaaaactgcattcaggttgtgccaccaccggtgaaaagccagagcaccgttggcgctggtgacagcatggtcggcgcgatgacactgaaactggcagaaaatgcctctcttgaagagatggtccgttttggcgtagctgcggggagtgcagccacactcaatcagggaacacgcctgtgctcccaagacgatacacaaaaaatttacgcttacctttcccgctaactgaaacattccccctgcattgggggaatcaccaccaacctgtcggcaacgcgtttctccgactatgctcaaaagtcatgtgataacaaaggggtgaactatggccagtggcgatcttgtccgttatgtcataaccgtcatgttgcacgaggatacattgactgaaattaacgagttgaataattacctgactcgcgacggttttttgctcaccatgacggatgatgatggaaatatccatgagctggggactaacacttttggacttatcagtacccaaagtgaagaagaaattagagaactggtttcggggcttacccaaagtgcaaccggcaaagatcctgaaatcaccatcacgacctgggaggaatggaatagcaacagaaaataaatggtttttgggcaataatcagtctgtggtgtgcgttagctcgtgtttttacaccgcattcttgcgctaaccttatgatctggcagacaacatgggagagacatcatgtggcaggcaatcagtcgtcttttgagcgagcagttaggtgaaggcgaaatcgaactgcgtaatgaactgcctggcggagaagtccatgccgcatggcatttgcgctatgcaggacgtgactttttcgtcaaatgtgatgaaagggaactgcttcccggttttaccgccgaagccgaccaactggagttactgtcgcgtagtaaaaccgtcaccgtgcctaaggtttgggcagttggcgctgaccgtgactacagttttctggtgatggactatctcccacctcgcccgctggatgcgcatagcgcatttattcttggtcagcaaattgcgcgtttacatcaatggagcgaccaaccgcaatttggcctcgatttcgataacgcgctctccacaactccccagcccaacacctggcaacgtcgctggtcaactttttttgctgaacaacggattggctggcagctggaactggcggcagaaaaagggatcgctttcggcaatatcgatgccatcgtcgagcatattcagcagcgtctggcctcgcatcaaccgcagccttctctgttgcacggcgatttatggtccggcaactgtgcgctgggtccggatggcccgtacattttcgacccggcctgctactggggtgaccgagagtgcgacctggcgatgttaccgctgcatactgaacagccgccacaaatctatgacggctatcagtcagtatccccgctacctgccgatttccttgaacgtcaaccggtttaccaactctacacgctgttaaatcgtgcaaggttatttggcggtcagcatttggttattgctcagcagtcactggatagattattagcagcatgatacgggttgaggataatggccgctccgtgcggccttttgattaaataaaccccagcagagaaaagaacacataacctgcagcaatacaaataaccggcaggatatacagcgagaaaaactgcaggaaaatagtatggtgcggcacaacaatacgtgactcaatttgttcacgcgttagcccctcttcccctttggctttttccagaatgagttgatcttcaacaccttcccgcaagaagcgcgcctggcgactcatccgggcaccggaatcctgcaacgccagtccgacaaaaatcaggatgaaaatcacccagaacataacgttcacgccaccattaaaattgggcgtcggggagttataccagaacagattcaaaaaaggcgtattcgcctgcatcatatcgatcatgacatgagtaaagtcgagcatgaccgcattaatgccttcctggttttcctgccgggtattcataaatttcagcaaagaaatcagtgtagagatcaatgcaggtataaaaatcacccaacccaaaatccttttcaaaacagcaatgcgtccagcttgttgatacgtcatgagttctccttgattaagacgcgtcgtttcacttagtttacctgtagatatctgttttcgcccattctttaaaggcgatatgataggcgcttaatcataagcacggcttaataccttacacataatgctctaaaggagaggttgtaatgtcaaccccgcgtcagattcttgctgcaatttttgatatggatggattacttatcgactcagaacctttatgggatcgagccgaactggatgtgatggcaagcctgggggtggatatctcccgtcgtaacgagctgccggacaccttaggtttacgtatcgatatggtggtcgatctttggtacgcccggcaaccgtggaatgggccaagccgtcaggaagtagtagaacgggttattgcccgtgccatttcactggttgaagagacacgtccattattaccaggcgtgcgcgaagccgttgcgttatgcaaagaacaaggtttattggtgggactggcctccgcgtcaccactacatatgctggaaaaagtgttgaccatgtttgacttacgcgacagtttcgatgccctcgcctcggctgaaaaactgccttacagcaagccgcatccgcaagtatatctcgactgcgcagcaaaactgggcgttgacccactgacctgcgtagcgctggaagattcagtaaatggcatgatcgcctctaaagcagcccgcatgcgttccatcgtcgttcctgcgccagaagcgcaaaatgatccacgttttgtattagcaaacgtcaaactctcatcactgacagaactcaccgcaaaagaccttctcggttaatgaccaggggcagtgatcacgctgcccctggttctttatctgaatttgcattcaactgacggattaatcgtcaatttaagagaaagagttacaccgtcaccacttccgcgcactgtataaaaatcctatactgtacgtatcgacagtttagtgagttttatcatgacggcggaaggtcaccttctcttttctattgcttgtgcggtatttgccaaaaatgccgagctgacgcccgtgctggcacagggtgactggtggcatattgtcccttccgcaatcctgacgtgtttgttaccggacatcgatcacccaaagtcgtttcttgggcagcgattaaagtggatatcaaaaccgatcgcccgcgcttttgggcatcgtggttttacccacagtctgctggcggtatttgcgctgctggcaaccttttaccttaaggttcctgaaagctggttcattccggctgatgcgctacaaggaatggtgctgggttatttgagccacatacttgccgatatgctgacacccgccggtgttcccctgctctggccatgccgctggcgtttccgcttgcctatcctggttccccaaaagggcaaccaactggaacgttttatctgcatggcattatttgtctggtcggtatggatgccccattcattacccgaaaacagcgctgttcgttggtcatcgcaaatgatcaatactttgcagatccagtttcatcggcttattaagcatcaggttgaatactaaaaaggcaaaaatcacctttctggaataagcaattccatttgaatataagagccagctcacagttctgttaatcttgcgccaacactatgactgctacgcagtgatagaaataataagatcaggagaacggggatgaactttccattaattgcgaacatcgtggtgttcgttgtactgctgtttgcgctggctcagacccgccataaacagtggagtctggcgaaaaaagtgctggtgggtctggtgatgggtgtggtttttggccttgccctgcataccatttatggttctgacagccaggtacttaaagattctgtacagtggtttaacattgttggtaacggctatgttcaactgctgcaaatgatcgttatgccgttagtcttcgcctctattctgagcgcggttgcccgtctgcataacgcatctcagttaggcaaaatcagttttctgaccatcggtacgcttttgtttaccacgctgattgcggcgctggtcggtgtgctggtcaccaacctgtttggtttgacggctgaaggtctggttcagggtggtgcagaaactgcacgtctgaacgccattgaaagtaactatgttggtaaagtctctgacctgagcgttccgcagctggtcttgtcctttatcccgaaaaacccgtttgccgatctgaccggagccaatccgacgtcaattatcagcgtggtaatttttgccgcattcctcggtgtagctgcgctgaaactgctgaaggatgatgcgccgaaaggtgaacgcgtcttaaccgctatcgataccctgcaaagctgggtaatgaagctggttcgcctggtcatgcagttgaccccttacggcgttctggcgctgatgaccaaagtggttgcaggttctaacctgcaagacatcatcaaactgggaagtttcgttgtcgcgtcctacctcggtcttctgattatgtttgcagtgcatggccttctgctgggtattaatggcgtgagcccgctgaagtacttccgtaaggtatggccagtactgacgtttgcctttaccagccgttccagtgctgcgtctatcccactgaatgtggaagcacaaacgcgtcgtctgggtgttcctgaatccatcgccagtttcgccgcctctttcggtgcaaccattggtcagaacggctgtgccggtttgtatccggcgatgctggcggtgatggttgcgcctacggttggcattaacccgatggacccgatgtggattgcgacgctggtcggtattgttaccgttagttccgcaggcgttgccggtgtcggtggtggtgcaactttcgccgcactgattgtgctgcctgcgatgggcctgccagttaccctggtggcgctgttaatctccgttgaaccgcttatcgacatggggcgtacggcgctaaacgttagtggctcgatgaccgctggcacgctgaccagccagtggctgaagcaaaccgataaagccattctggatagcgaagacgacgccgaactggcacaccgttaattcttatgctggcaacggtccgttttgtataggagccgttgccttactttttaaatgttccatcgcggcgatgcatactgactcatatttaaacagatcgtcagcgaaaaaaatggctaacttatcgatacattcctgactcaatgaatgtgcctgtagcgaaaagcttaaaacctcatacccaagacgttttctaagtgaactatctgaaatactcataatctcttcaagcacaccacttcccattcccggaagattcagtggattaaaaagaagattgacattaagtattgatattaccgaaggaaactttaggagactctcatttttttgaatcgcagcaaaaatgctcccaacaggatgtatataattttgttcatagtatatcgtttttaaatagtgaataaccaacctgttttttatattgatcaaattggtcattttttctggtcggaattcacaagtaaaatccatcccaacaaaattctcattaatacctcttatcctaatttcactaccataaagattattaattatcactctatatttaacattgtcctgcagatatgtatcaaaactaagtgctggcgctcctggctttgaggcatcatagttaatgttagacatataggcaatcatataattgaagtttgattctgctatttcatcgcaggcacattgacccgttgatataaagaaagtgagtgctgtcatggtagactgcagtctttctttaaaagagtcgaaggcaaggtttttaatatttaaattaccataatcactctgtattaagtttgtagaaaacatctcccacctcatattatcaacaaaattattatctcatttgaatctaagcaatttacaatataagtttaatggcaacgccacaggatgaactatcaaaaatagctcatcctgattagctaaacttaactattataaaataaataaacaattaaagaaaaaagatcacttatttatagcaatagatcgtcaaaggcagctttttgttacaggtggtttgaatgaatgtagcaatgaaatacagaatttcaggccatgtaactcccggcaaaaccgggaggtacgtaatctttactcagtcacttccccttcctggcggatctgatttgcccaacgctgggcggattcaggcacagtaaacgccggtgagcgcagaaatgactctcccatcagtacaaacgcaacatatttgccacgcagcatccagacatcacgaaacgaatccatctttatcgcatgttctggcggcgcgggttccgtgcgtgggacatagctaataatctggcggttttgctggcggagcggtttcttcattactggcttcactaaacgcatattaaaaatcagaaaaactgtagtttagccgatttagcccctgtacgtcccgctttgcgtgtatttcataacaccgtttccagaatagcctccgaagcgggatctggctggtggtctatagttagagagttttttgaccaaaacagcggccctttcagtaataaattaaggagacgagttcaatgtcgcaacataacgaaaagaacccacatcagcaccagtcaccacaacacgattccagcgaagcgaaaccggggatggactcactggcacctgaggacggatctcatcgtccagcggctgaaccgacaccgccaggtgcacaacctaccgccccagggagcctgaaagcccctgatacgcgtaacgaaaaacttaattctctggaagacgtacgcaaaggcagtgaaaattatgcgctgaccactaatcagggcgtgcgcatcgccgacgatcaaaactcactgcgtgccggtagccgtggtccaacgctgctggaagattttattctgcgcgagaaaatcacccactttgaccatgagcgcatcccggaacgtattgttcatgcacgtggatcagcagctcacggttatttccagccatataaaagcttaagcgatatcaccaaagcggatttcctctcagatccgaacaaaatcaccccagtatttgttaggttctctaccgttcagggtggtgctggctctgccgataccgtgcgtgatatccgtggctttgccaccaagttctataccgaagagggtatttttgacctcgttggcaataacacgccaatcttctttatccaggatgcgcataaattccccgattttgttcatgcggtaaaaccagaaccgcactgggcaatcccacaagggcaaagcgcccacgatactttctgggattatgtttctctgcaacctgaaactctgcacaacgtgatgtgggcgatgtcggatcgcgggatcccacgcagttaccgcaccatggaaggcttcggtattcacaccttccgcctgattaatgccgaagggaaggcaacgttcgtacgtttccactggaaaccactggcaggtaaagcctcactcgtttgggatgaagcacaaaaactaaccggacgtgacccggacttccaccgccgcgagttgtgggaagccatcgaagcaggcgattttccggaatacgaactgggcttccagttgattcctgaagaagatgaattcaagtttgacttcgatcttctcgatccaaccaaactcatcccggaagaactggtacccgttcagcgtgttggcaaaatgatgctcaatcgcaatccggataacttctttgccgaaaacgaacaagcagcattccatccaggtcatattgttcctggtctggacttcaccaacgatcccctgttgcagggacgtttgttctcctataccgatacacaaatcagtcgtcttggtgggccgaatttccatgagattccgattaaccgcccgacctgcccttaccataatttccagcgtgacggcatgcatcgtatggggatcgacactaacccggcgaattatgaaccgaactcgatcaacgataactggccgcgcgaaacaccgccggggccgaaacgtggcggttttgaatcataccaggaacgcgtggaaggaaataaagttcgcgagcgcagtccatcgtttggcgaatattattcccatccgcgtctgttctggctaagtcagacgccattcgagcagcgccatattgtcgatggtttcagttttgagttaagcaaagtagttcgtccgtatattcgtgagcgcgttgttgaccagctggcgcatattgatctcactctggcccaggcggtggcgaaaaatctcggtatcgagctgacggacgaccagctgaatatcaccccgcctccggacgtcaacggtctgaaaaaggatccatccttaagtttgtacgccattcctgacggtgatgtgaaaggtcgcgtggtagcgattttacttaatgatgaagtgagatcggcagaccttctggccattctcaaggcgctgaaggccaaaggcgttcatgccaaactgctctactcccgaatgggtgaagtgactgcggatgacggtacggtgttgcctatagccgctacctttgccggtgcaccttcgctgacggtcgatgcggttattgtcccttgcggcaatatcgcggatatcgctgacaacggcgatgccaactactacctgatggaagcctacaaacaccttaaaccgattgcgctggcgggagacgcgcgcaagtttaaagcaacaatcaaggtcgctgaccagggtgaagaagggattgtggaagctgacagcgccgatggtagttttatggatgaactgttaacgctgatggcagcacaccgcatgtggtcacgcattcctaagattgacaaaattccggcgtaaatatggataaggtcacgccccctggggagtgaccttaccaccttacttacacatcaagataactacccaaccgataaccacgctcagcaatcgcatatttcaacgacgctgaagtcagcacatccagttccgttaaccgaggtaagcaataagcactctggcgaatcgtattatcgataaacgccggatgacacatcacttccagagagcgctcgccgcgatgactggagtcatcaagcacttgcaggaacagcgactcactgatctcttcaccgtagaatgcactgctgaatccctgggtagtgcgcaggttgaccggcaaatcaaacaccatctgacgatccgcccgcaacgcaatcccctcttcagccgcaaacctggcaacaatcgggaaaatctgcgggaacatatgcacatgatgatggctatcaagatgcgtaggtttgcgtccaaatagctcaatgaaacgcaaatactgactggcaagctcctgagtaatttcttccagcggtaaagcatcttcttctgccaactgccagatccattttcccagcacaccatcgcgggttaaccccggcatagctgtcagtggcttgcccatagtaaggacaaagtgcatccctatggccagactcggttcatcacgactcaactgcaccgcatggtcaatagcctgcccattcaccagcgccgtcgtcgatgtgacaatcccattgcgacaggcctcgataatgccgtagttctgacctttgcttaagccaaaatcatcggcattaacaatcaataagcgttccataatcagcctcggttaatgtgcttttttaagctctgcgatgcagtcggcaaaatttggcagccatttctcgtgcgccagaatcatctcgcgtgccagcagctcagcatcgcgatcggaatgcaccaacggactaaggtttagcgccagtaacacatcgttaaattctccgctaagtgcagcgttgctggcagcaatctcgaagcctttaatggtgtgaatcagccccatcactttatcatcgaaatgcgtaatgcgcggatgtggcgtcgcgccatcgcgccccagcgtacaggtcatttctaccgcccagtctgccggaatattatcaatatgcccatgatgcgggatattaacgtaatgttcagcttgcttgtcgttgtagatagcgttgatcacttcgcacgctgcatcagagtaataagccccaccgcgctgttccagttctttcggcttaactttcaactccgggtttttatacagctcaaaaagttgtttctcgactttctgtactacctgtgctcgtgcgccgcctttgtagtattcgcccatttcaatagccagcatctctttttgcttgaagtaataaagcaaataagaacacggcaacagatttagagaacgaattaaaccttcgctaaatggcagatcgaaaatatttttaacgccagatgcttttaactgcccggatgccacaccatcaagcaattcggcaaagcgtgatttgccatttaccagcacatctttaatgaacaccatatggttgaggccgaacagatcgatagataaatcatcgctgtctttcagcatcagaacatcgcgaataaacatcttcatgccgatcggaatattacacacgccgataaagcgtttaaatccggtatgacgataaacggcttcagtgaccattcccgccgggttagtgaagttaatcacccatgcattcggacaaagttcttcgacatcttttacgatgttaaaaatcaccggaatggtacgcagacctttaaacagaccgcccgcgccgttagtttcctgaccaagataaccatgacttaatggaatacgttcatccagttcgcgcgccggtaattggcctacgcgcagttgggtagtaacgaaatcagcatctttcaatgcttcgcggcgatccagcgttttataaagcttcatcgggacgccagcgttatcaatcatccgttggcagagatcaaaaataatatccagtttagctttaccaccttcgacatccaccagccataattcgctgaccggcaattcgtgataacgcttaataaatccttccagtaactccggggtatagctgctcccgccaccaatagtgacgacttttaatttctggctcataatttctcccttcagtacagaatactgatatctggcatatctgcccccccggacataaataatccagcaacaggacagatatgtgaattgtcaggtataacgacttactgattaaattcagtcaatttcttacgatagctcttaggcgtaaaggacgttaatttcttaaacgttttaataaacaaactcgggctactataaccggcctcaaacgcaatatccgtcacggaatagttggtcatttccagttgttttttggcaaaattaatacggatctcattaataatctgcattggtgttttgccataatatcgttgagtcgctcgcgtcaaatattcctgtgatttggctgacaacgtcaccatattctccagcgccgattcactaaactgctctttatcatgcatcttttctaccgtacttttcagccactgcggtacatcatcaatcacctgttcttcgcggtaatgacgtaaacggttaatgacataaaaagtaaccatctcaacaaactcttccagccctgtttcgcggaaattcaatgaagaaatcactgtttccacataggtgagaaaagcgttattggttcggtatacctgcgaagctacaaagcaataaggcaacaacggcaggtaatgctgctcaaaaaagcgtttactgatcccaacgttcaatatgcgcgtggcaccaaactcataaaaactttgatggtgcgaacctaacggaataaaaacaaaatcgccccgttccagtaacacgcgcttaccgttaatctcctggaaataacgcccggttaataccagagtaaattcataatagtcgtgctgatgcagtccgctgatactctcagttttgttatagataaacacatggaaatttttgccattaaacaactgctgttctcgggcagtggcaatttccggcgcgttaatcactggctgcatcatcgactccttatgccttcagtttttcatgaagctcaattaattcggtaatcagttcacgcgcaagcatggacgtcattaaatgatcctgagcgtggaccagcaccagactcactttcatcttaccttcgcccgcatcgccttcaatcagtttcgtctgtaccagatgcgcttcattcaatgctatccgtgactgatccatcatggcttttgctgcggcaaaatcgccctgcttcgcctgtttcagtgccgcatacgccaggctgcgcgcttgtccggagttgatgataagccccatcaccacttcttccagctcttcagcttccgtttgcgtatcgggaatattatcgagatccatcatacatcgttcctctctattcttaccggcacgattacccgtaccggcatcgattaaaatttcagggcgttagcgatatcttcttcgctctcttctttatcaatcgcattttgtgctttgttagccaccacaacaaagggcagataaattaacgttgcgataccaaggttgaagagtgcgaccagcaatgcggcgacgctaccgttggtgttaaagaaggctcccagaccggttggcatggtccacggtgcaatattggtcaccggaggaataatgcccatgtagtacgctgccagggtgattgccgccagaatcggttgtaccagtacaaacgggataaacatcaccgggttcatgataattggcagaccaaacagaatcggttcgttaatctggaagatgccggacggcagcgccagttttgccacctgacgataatcagcacggcgagaggcgataaagatagccaggatcagacctaaagtcgcaccactgcccccaaggaaaataaaggagtccagcatcggcttggcccagatatggaaggtcttaccggctgccagcgccgcttcgacggaaccatattgctgataggtcgcgatattttccagcgcccaaggcgtcataatgccgttgtccagtgcggtcagcgccagcgcaccatgaataccgaagaaccagagcagtggaacaaagatcacataggcccagcccaccacgctacccaacgatgccagtggggttgagatggtatccataatgatctgatggaagttggtgccccaggtattcaacgcccaggcaataatccccatcacggaaagaataataaagccgggaattaaagccgagaaggaacgcgatactgaagcaggtacgctatcgggcaatttaatgacccaattgcggcggacaataaaggtaaacatttctgccaccaccaggccaataataatcccggagatgatattcgccccacctaaccagtttgcgccaaccgcataggcctcaccgacactgtatggggtgacggtcataaatgctgcaacggataacaacccagccgccagcgcatcgactttacgctcttctgccagcgccatgccaataaagaacggtgccattaaagacattatccctaatgttccgttatatacgttgccgccaatacctttcagaccattaagtgtttcaatggttgaggcatccaggcgaatacctaaggaataaaaaaacgacccctccccaaagcttagaaaaacgttgttaattaatacaaacatggcccccgcaagggttaacggcattaagcgaataaagccatttttgattgcattaacgtgtggctgctttcctattttaactgcaaaagggaggagtaccttttcaagcgatgcaataacattactcatagaaaaatacccttaaaaaccgcaatttaaatattacggtattgatttatgaaataactctttgacgggaaaatttaaaataaattaatttgctgcggcttttttaatcgctgcaaccgcagccttaagcacgcctaaaccatcgactttgccataaagcagcgagtcaattacttcaaccggtttgttgggtaacaaacgctggatttcgggcaacatataagcaatctgcggccctaataacacgacatcggcattctgacctttttcaccagccagtgtttccggaaatgcttcaataatgaccggaacttcatatttttctgcctgtgcgcgcatttttgataccagtaaagaggtagacatgcccgcagaacaaaacagataaatgtgtttcttttccataaaactgccctcatcgacgattatctgtcagccagacactccgcaagccttaacctgcttccatgctctgggtaacttgcgaaaccaacatgactttttttgtggctgaaaggagtatacggtatagacctgagcaatagtatttctttgaccttataaattgtctctccttgacctgcggttatgaccctcttcacatttcgggcaaataattcgcgaagataattaagaactcaggccaaaaaaaaccggcgcaatggccggtttccgttgtaactcaagctttcaggcgaagtgattacttcgcagcctgtggatcagtgtcgtattcagcacaggtctgataaccggagttgatgacatgtccggtatcatctaacgcgacaaagtaggtttctgctttaccatcacgttgacccaggatgtaggtctggcaagtaccacgagcatggatcatgctcacttcagacgaaggtttacccgcaatttgtgcaacctgcgcccggctcatgccttttttgacgtctttcaccacaggctgtacaaactggtctttggtacgatcataagccgtacaacccgccagcatggttaataccgccgctgcactcagaattcctgccatattcttgttcatattccgtcctcttgtttatcagcgtgttagataagcctggaatacattgggcgctttttcaagcccgtgaacgaaacggctccgctttcagaggattcctgtatgacgttttaaccaccattcagcccgctgtcgcttgtcgtttcagtagcaacgggttagctttaaggaagttttgtcttttctgtctggaggggttcaatgacattgcaacaacaaataataaaggcgctgggcgcaaaaccgcagattaatgctgaagaggaaattcgtcgtagtgtcgattttctgaaaagctacctgcaaacttatccgttcattaaatcactggtgctagggatcagcggcggtcaggactccacgcttgccggaaagctgtgccagatggcgattaatgagctgcgccaggaaactggcaacgaatcactgcaatttattgccgtacgcctgccctatggtgttcaggctgacgaacaagattgccaggatgccattgcctttattcaaccggatcgcgtattaaccgttaatatcaagggcgcggtattggccagcgaacaggcgctgcgcgaagcgggcattgaactgagcgattttgttcgtggcaatgaaaaagcgcgtgagcggatgaaagcacaatatagcattgcgggtatgaccagcggtgtcgtggtgggcaccgatcatgcagcagaagccattaccggattcttcactaaatatggtgacggcggtacggatattaatccgctgtatcgtctcaacaaacgccagggtaaacagttactggcggcattaggttgcccggaacacctttataagaaagccccaacggccgatctggaagatgatcgcccttctctgccagatgaagtggcactcggcgtgacctatgacaatatcgacgactatctggaagggaaaaacctacctgaacaggtcgccagaacaatagagaactggtatctgaaaaccgaacataaacgccgtccgccaattaccgttttcgatgatttctggaaaaagtaataatttgcacatattggtttgtgcgaaaaagagtactttgttcacgccggatgcggcgtgaacgccttattcgacctacaaaactatgcaaattcaatacattgcaggagtcgaataggcctgacaggcgtagcacgtctcacggtgtaacctttgtcatcaacccgcctcttttttaatcgctccccgcctgttacactggatagataaccagcattcggagtcaacagtggtacggcgtttaacttctccgcggctcgaatttgaagctgcggcaatttatgaatatcccgaacatttacgttcattccttaatgacttacccacccgaccaggggtgtatctgtttcatggcgaaagcgacaccatgccgctctatatcggcaaaagcattaacatccgcagccgcgtcctttctcatttacgcaccccggatgaagccgccatgctacggcaatcccggcgaattagctggatctgcaccgcaggcgaaatcggcgctctgctccttgaagcgcgattaatcaaagaacaacagccgctgtttaataaacggttgcgccgcaatcgccagctctgtgccctgcaattaaatgaaaagcgcgtcgatgtggtgtatgccaaagaggtggatttttcacgagcccccaacctgtttggcctgtttgccaataggcgcgcagctttgcaagcattgcagaccatcgctgatgaacaaaaactttgctatggcctgctgggactggaaccgttaagccgcgggcgtgcttgttttcgttctgcattaaaacgttgcgccggggcgtgttgcggtaaagagagccatgaggaacatgcgctacgcttgcgccagtctctggagcgtttgcgggtggtgtgttggccttggcaaggggcggtggcgctgaaagaacagcacccggaaatgactcaatatcatattattcaaaactggctgtggctgggggcggttaattcgctggaagaagcgacaacgttaattcggacacccgccgggtttgatcacgacggttataaaattctttgtaagccgctgctttccggtaactatgaaattactgaacttgatccggcgaatgaccagcaagccagttgatttcactgaacaacagtttaccctgcggttgtaaaagccgcagggtgtgcctgccatcgaaccagcacgcgccctggtcggtagtgagcagtttatcgcccaattgccacgccccgttaatgacaaacactaccccgccgcgtgagccaaaggtagtaaacgtacgttcggcaattctgactttcgccttacagacatccaggcgtgtcatgatgttgaaatccatcgacatctgccctgccgtcagtttcgcttttaccacctggtccgccgcaaaggcaaaaggctgtaacggttttaaggtatggttaaagcggtctgcgctttcaaggaacatctcgccgccttccagcaacgtcactatcctttccataccgggaaacaaagaaaactccccattcgccgcgatggatgcaatgctggcacgccagtaaaaatcacgttttgccggtgggaaagtgcaaatttcgcgcgtttcaccggcagcatttcgccacagattcaccgacattttacgcatatcaaagtattccatactcgctcccggcccgttcttttcattgttatcgttcaggtaaccgtggatggttatcggcaactcgggtgatttacgttagtggtgatcaggctttttttacaactgtttgagaagagaaaagaaaaccgccgatcctgtccaccgcattactgcaaggtagtggacaagaccggcggtcttaagttttttggctgaaagattattcagcagttgcaggcattttaccttttgccgctggacgttctgtcagacgcttctcaaaattagcattaaattgctttttctgttccggcgtcaggatgttgtaaattttgttctgggtttccatgtgcgccagcatgttagctttgcgctgttcttccatttttgcgatctgcgcttcagcttttgctttatcgaaggtatcgctcgcaatgatgtcatgcattgcgcggcgttcttccagcggcggacgtttcatctggtcacgctggcctttcatgatttcgcggatctgctgtttctgcgcgtcggtcaggttcaggtctttgaacatcatgtcctgatgcggaccaaacttgcctttgtggtgcatcatcggcttcgcgtcagccggtgctgcggtagtggtgtctgcggcatgggccaggttagccgcgccaagagccagggtagaggcaacaaacaatgcagttaatttacgcatattctatatccttcctttcagttatttattacggctttcttaagtagcgtgccgtgttgacgagattaactttactgactttagcgtcaattaatcagagcaacggtaaaacaatgaaagtgtaaaaaacacttttgcgccaattatggagaaaaaaagaaaatttgatggagagtgatgagagaatattacaacacgatgattttgcagagattatgaagaactataccggatgactggtgatgaataaagcaaataaccaggattaatctgtattaatttataagaaagcaacttaatacccgcagaatgatttctgcgggtaagtattagcttattttttcgagcattaatcccgcgcgtaatcccaacgctaccaaaggattagggaataacacatactctacatcatgggttacggtaaaacgttcctccccgtcctgcgccagcaatgttcctttctcaaacggcataaaattcagcgtgtcacttgccatatgcatttcgaaggacggcgagtggcgagtaatttgcgaaaccacccgataacggagcggcggcgttctcacgataccgacattctcaccagatagcagcgcagcaattgcgctggcagtgactgcaaactggcgaagatcgttttgtccaaagggcaacgctttgccgagttccagcgtacaggccagcgcgccaaaatgtctggcgctaaaatgggtaaacgtaccaccaggcgtctgatggaataccagtgcctccagccccgccgcccccagccacgtcagaaatttctcgtcccagggaatgtcgcgttgcggtaatacaccaaactgcggatgcaaggagccacgaattgcggtatggagatcaaggtgccagcgcacagattctttgccctggtcataaaaatcttccaggcactgttccagttcgcgcgcgcgacaggtttccccgctttcagcaaatagctgccaacgaccgccaaacattcggttcatatcgctatggcaataacgtttcccttgcttcagcgcaggaggattcccgaggatcaccagcaaccgccaacgtaacgggatctcgccgtgagatatcgcgccaagcaacgcgtccagcatctccacaggtgccgtctcattaccgtgtattcccgctgaaatcaccagtgcgccttgcggtggcgttaatggcgtcagttccagcacaccatcgcccagccagagccagcgaacgccgttgatttctcgctcggtgataaccggttttttacccgttaaggtcagagcaagaaaattatccattgccccctccctcgcgctggaacggataaaccgaaccgagattcagtaattggctcaatacatccagtgcttcccgcccttcacgcagcaattgcgggtcggccagatcggcagcagtaagacgatcgcggtagtaacgatccacccagtcattgagcacattaaacagcgtatcgttcatcatcaccgccggattcaccgcctggcgttcttcttctgtcaataccacgcgcaaccgcaggcacgccgggcctccgccattcgccatgctttcacgtaaatcaaagacttttagttcgctaatcgggttgtcagcggcaaggagttcattgagatacccccatactccggcgtgttcccgacactcctgaggcagcaccaacatcatggaaccatcatcgcggctcagcagttggctgttaaacagatatgtagacaccgcatctgacacggaaacctgagtcgccggaacttctatcgccataaaaccgttcacccgcgcacgcaggtttgccagtaactgcacctgtcgagcgaacgcctgttgatgacaaaacagcacctggcggttactcacggcaatcacgtcattatgaaaaacgccctggtcgataacgtccgggttttgctgggcgaaaatcacctgttggggattcacctgattcagccttgccaccgcctcgctggcttcgcgagtctgccgcgccggataacgggaaggccgggtatcattgccttcttctcgcccgtagacaaaaagttgcatacccggttcaccgtaatgaccgccgagacgattgtggtttgccgccccctcatcaccgagcaaggctacctgcggcaacgccgaatggacactaaatttctcttcgtcgttaaaaatcgcttttaacagcgattcagtgacgggggcttccagcgaacggtgaaatttattgttcaggttggcaacggtgagatgcactttgccatccagcgtatcggcagatggcgcgatcgttgccgcattggctacccacattggcgaagcggaactaacgctggaaagccagtgcggtgcctggcgtgcaaccttttccagcacttgttcatcgctaccactgaatcccaactgacgtaaaaccggtataaacggacgctcgtgcggcgggatcacggcctgggggaatcccgcatcggcaagggttttcattttcagtaagccctgtttcgccgccagtcgcgggttagagacctgaaaacggtgacgggtagaggcttcattaccaaacgacaggcccgcgtaatgatgcgtcagccctaccagcccgtcgaaattgacttcccaggcgttcatcgcaccacctcatcggaaaaatccaacccggggttaagcgtggcgggcaatgttaacgagtccgactccaggctcgccatcggccaggcacaataatctgcggcataccaggcgctggggcgatggttaccggaagcgccaatgccgccgaatggcgcggtactggcagcgccggtaagcggtttgttccagttaacaatccccgcccgcgcctcaagcagcagttgatcgaatttttcccgcgcgggggaaaccagaccgcatgagaggccgaagcgagtgttattcgccattcgaatcgcttcatcgaaattgtcataacgccagacgcgcaataacggtccgaacacctcttcatctggtacgccagcaacgcccgtcatttcaatgatccccggcgtcagcaacgatgtccctgcttgtaataagcacggcgcaagcaggggtcgtccacccatcgcttccagttgctgccaggccgtcaccacctgctgcgcggcctgatctgatatcagcccgccaataaacggctgcggttcgtcatcccatttgcccggcgttaatcgctggctgacggcaaccagacgagcaagaaacgcatcgccctgcgccccgcttttcagcaataaacggcgggcgcaggtgcagcgttgcccggctgtgacaaatgccgactgaatggtcagatggacagcggcatcgatatccgccacctcatcgataatcagcgggttattgccgcccatttcgagggcgagaattttctccggctgaccggaaagctgacgatgcaactggtagccagtattggcgctaccggtaaacagcaagccgtcgagatcctccagcgcactcagcgcctgacccgtttcacgcccgccctgcaccaggttcagcacgcccggcggcaagccagcctgctgccataaacgcattaccgcttcgccgctccagggtgtcagttcgctgggtttaaagataatggtgttacccgccagcaatgccggaacgatatgcccgttcggcaaatgaccagggaaattatacggcccaaacaccgccagcacgccgtgcgggcgatgtcgcaggctcgccgcgccgtccggcatttcgctacgctgctcgccggtacgaacgtgatacgccttaattgatatcgcgattttattgatcatcgccgtcacttcggttgccgcttcccagcgcggcttacccgtttctctggcaataatcgcggttaattcggctttattgctttccagcaatccggcaaagcgttcaactcttacctgacgatcgccaaaggagagacgcgcccagcgcggaaacgccgcacgggctgcccgacaagcctgcccgacctgagcggcatcggcatcattgccctgccataacacctctcccgataccggattacgcttcacacgcaatgcgccctggcccgttacccagtcaccgttgatccataaagtcatgctgttttctcctctgcgcacaggcgcaccagacgaacgcgatccccggcgtggcatttgagggcatccagttgtgcggcggttaaaatcaaacgctcggttgccggatcggtacgcaccagcaccacgcggaaatggtgataattttcattggcgaccaggcaggccggaaaatcgccctgcgcaggctgcccttctgccacttccaccagccgacttttacggatggcgcgcacgcggtcgatgtcacactcaagcgtcggcccaccgtcgaagatgtcgatataattacggtagcgaaaaccttctttctccagtaccgcacgggcaggcgcggtttgcggatgtacctgaccgatgacgtcctgggcttcctgagataaaaagtgggtatagatcggatgtttcggcatcagttctgcaataaatgccttttgcccggtgccgcagagaaaatcggcgcggctaaaatccatcgaaaagaagcgcttaccgaggctttgccagaacggtgaatagccatgttcgtcaatcaccccgcgcatttcggcaaccactttgtcattaaacttgtcgcgaaaagccgccataaacataaagcgcgatttcgacagcaaatagccgttgccctctttgcgccactccgggtcgagaaacagcgtgcacagctcgctgctgccggtgtgatcgttactgagaaacagcgtcggcaacgcgttatagacattcagctctttcgaagcgtgaaccagcgtgccgacgcgatagttgtaccagggatcgttcagcccaactgccacctcaatggcgcaaatccccgccactgtgcctgtctcgctatcttccagcacgaacacatagccctgctcacttttgggcagttcgccttgccaggttttgattgccctttcgatacgcgccgaaagcgtggcttcattggcgggaagcgacgtcaggccgccgcccgttttgctggcaagctgcatcagcgccgagacatctgagcgctcaacgggacggatgaccatcatgatgaacctcggctaacaaagtggtcgcaagcagctgcaaagcgatccagtccggtcgtcacctcttcttcgctgacattgagcgcaggcgcaaaacgcaccacgttgccacccgcaatcagtaccatcacgcctgctttcgccgcttcctgagagatctgtttcgcttgcccggcgtaatcggcattcagtacacagccaatcaacaaacctaagccgcgaacttcactgaacaaaccgcagcggtgattaacggtattaagacgctcaacaaaccagtcgtgacgctgcttaaccccgttaagcatctctggcgtgttaatgagatccagcactttgcctgctaccgccgaggccagcggattaccaccataggtggtgccatgagtgccaacggtcatcacgctggcgcactcttcggttgccaacaacgcaccgaccgggaaaccgccgcccagcgctttcgcggtagttaacagatcaggcgtcacaccgtagtgcatataggcatacagttccccggtgcgcccgacgccagtttgtacttcatcaaaaatcagcaatgcattgtggcggtcacacaattcacgcagaccatgtaaaaatgcgttgctggctggcaccacaccgccttccccctggatgggttcgacaatcaccgcacaggtagagtcgtcaatcagcgcgctggcagagttaatatcgttatatgcagcatgacgaatatccggcggcagtggcgcaaaatcctgtgaataggcgggctgcccacccgcactgacagtaaacagcgtgcgaccatgaaacgcatttttgaacgccacgataccgctcttatggctgccgtagcggtcgtgagcgaatttacgcgccagttttagcgccgcttcgttggcttccgcaccggagttacaaaagaagacgcgatcggcaaacgtggcgtcgatcaattttttcgccagtcgcagtaccggctcgttggtgtaaccgttgccggtatgccagaacttactcgcctgttcgttcagcgcctcacgcagttccgggtgcgcatggcccagcgcgttcaccgcaatgccacccgcgaagtcgatatactctttcccctgctgatcccacaagcgcgaaccttcgccacgtaccggtataaacggtgccggagcgtaaacaggtatcatccattcatcaaagttttcacgcgtaattggctgagacatagcgacctctacagtaaataattcgttatttatatgttaataataagtaatgtttgcgctgtaaatgtagattgcagggttcgtgccagccagtgataaaagtgcataaaccgcggtggctaactggaaatcaaggagttataaccaaaccatatgcatttaaagtgcatataaagtgaatacgtttgcgatgtgggtgaataaaaagaataaaaaacgcaatgttatgcagaagtaaaatataattctggaattgtgatcattgacgaaatttactggaaattactgcgccattctgacgcaacgcgcaccaaaagcgggcattttttgcgccatcgttgacatcattaacaaccatcgatcaaatcacttaacaacaggcggtacgcaaagcgaaattctgctaccatccacgcactctttatctgaataaatggcagcgactatgaaatttgtctcttttaatatcaacggcctgcgcgccagacctcaccagcttgaagccatcgtcgaaaagcaccaaccggatgtgattggcctgcaggagacaaaagttcatgacgatatgtttccactcgaagaggtggcgaagctcggctacaacgtgttttatcacgggcagaaaggccattatggcgtggcgctgctgaccaaagagacgccgattgccgtgcgtcgcggttttccgggtgatgacgaagaggcgcaacggcgaattattatggctgaaatcccctcgacgctgggcaatgttaccgtgatcaacggttacttcccgcagggtgaaagccgcgaccatccgataaaattcccggcaaaggcgcagttttatcagaatctgcaaaactacctggaaaccgaactcaagcgtgaaaatccggtgctgattatgggcgatatgaatatcagtcctggcgacctggatattggcattggcgaagagaaccgtaagcgctggctgcgtaccggaaaatgttctttccttccggaggaacgcgaatggatggagagactgatgagctgggggttggtcgataccttccgccatgcgaatccgcaaacagcagatcgtttctcatggtttgattaccgctcaaaaggttttgacgataaccgtggtctgcgcatcgacctgcttctcgccagccaaccgctggcagaatgttgcgtagaaaccggcatcgactatgaaattcgcagcatggaaaaaccgtccgatcacgcccccgtctgggcgaccttccgccgctaatttagctgttctcctggctcaaactgggtcaggagaattaaccttgagaaaaatcaacaaactgtcagtaatgatttgttgcctgccgccctttgttataccgtcactgcgtttttagttgtctgaccacttctctattatcaagtttgatataggaaactccacgatgaacgctgagcgtaaatttctttttgcctgtcttatttttgcgctgctcatttacgctatccacgctttcggtttattcgatctgctcaccgatttgccccacttacagacactcattcgccagagcggattgttcggttatagcctctatattctgttattcatcattgccaccctctttctgttaccaggaagcatactggtgatcgctggaggaatagtttttggcccgctcttagggacactactctcattaattgccgccacgctggcctcctcgtgctcattcctgctggcgcgctggctgggacgtgatttactgctgaaatacgttggccatagccataccttccaggccattgaaaaaggcattgcgcgtaatggtattgattttcttattctgacccgcttaatcccgttgtttccttacaatattcaaaattacgcttacggattaaccacaatcgccttctggccttatacccttatttcggcactcacgaccctgcccggtattgttatttataccgtgatggcaagcgatctcgccaatgaaggcattacgctgcgctttattttacaactctgtctggcgggcctggcgctgtttattctcgtccagctcgcaaaactctacgcccgacacaaacatgtggatctgtctgcttcgcgccgcagcccacttactcaccccaaaaatgaaggatagaacgatgttgcaacattattcagtgtcatggaaaaaaggactggctgcactctgcttactggctgttgccgggcttagcggctgcgatcaacaagagaatgcgggtgcaaaagtggaatacgacggactttcgaatagccaaccgctgcgtgtcgatgccaataaccatacggtaaccatgctggtgcaaattaatggtcgtttcctcaccgacgacactcgtcacggtattgtgtttaaagatggctccaacggacataaatcgctgtttatgggttatgcgaccccgaaagcattttatgaagccctgaaagaggcaggtggtacaccgggcgaaaacatgacgatggataataaagaaacgactcatgtcacaggcagcaaactggatatttcggtcaactggcaaggggcggcaaaagcgtattccttagatgaagtgattgttgacagtaatggcaagaaactggacatgcgctttggcggtaatttaacggcagcagaagagaagaaaacgggctgcctggtgtgtctggatagctgcccggtcggcatcgtcagcaatgcaacatacacttatggtgcggttgaaaaacgaggtgaagttaaattcaaaggcaatgcctcggttctcccggcggataacacgctggcaacggttacctttaaaatcaccgaataaagccagaataaaggatgatgaagatgcaatcgcgaaaaatctggtattaccgtataaccctcatcatcctgttgttcgctatgctgctggcatgggcgctgcttcccggcgtccatgagtttatcaatcgcagcgttgcggcgtttgccgccgtggaccaacagggtatagaacgctttattcagtcttacggcgcactggcggcagttgtctcgttcttgttgatgattttgcaggccattgctgcaccgctacctgcgtttctgatcacctttgcaaatgcgtcgctgtttggcgcgttctggggcggcttgctgtcgtggaccagttcgatggccggcgcggcgctgtgcttttttatcgccagagtgatgggccgcgaagtggtggaaaagttaacgggtaaaacggtactcaatagtatggacggcttttttacccgctatggtaaacacaccattctggtatgccgattattgccttttgtgccttttgatcccgtaagctatgctgccggtttgacttcaatacgttttcgctcgttttttatcgccaccgggcttggtcagttaccagcgactattgtttattcctgggcgggcagcatgttaacaggcggtactttctggtttgtcaccggactgtttattctgtttgccctgaccgtggtgatttttatggcgaagaaaatatggcttgagcgccagaagaggaatgcctgatgggtttaccgccgcttagcaaaattcctttcattttacgtccgcaggcgtggctgcatcgtcgccattacggcgaggtgctaagcccgattcgctggtgggggcggatcccgtttatcttttatctggtgtcgatgtttgtcggctggctggagcgcaaacgctcaccgctggatccggtagtacgatcgcttgtcagcgcgcgcattgcgcaaatgtgcctgtgtgagttttgcgtggatatcaccagtatgaaagtcgccgagcgcactggcagcaccgataaactgctggcagtggctgactggcggcaaagcccgctctttagcgatgaagaacggctggcgctggagtacgccgaagccgcaagcgtaacgccgccaacggtcgatgatgccctgcgcgcccgactggttacgcattttgacgctcaggcgctcaccgaactgacggcattgattggcctgcaaaacctgtcggctcgttttaattctgccatggacattcccgctcaggggctgtgccgtattcctgaaaaacgttcttaaggagagatgatgcgccattgtgtgtggttgctgggattgttatcgctgttttctttggcaacacatgccagtgactggcaggaaatcaaaaacgacgccaaagggcaaaccgtctggtttaacgcctggggcggcgatacggcaattaaccgctatctcgactgggttagcggcgagatgaaaacccattacgctataaacctgaagattgttcgtctcgcggatgccgcagacgcggtgaagcgcattcagaccgaagctgctgccggacgcaaaacaggcggttcggtggatctgctctgggtgaacggcgaaaacttccgcaccttaaaagaggccaatttattacaaacgggctgggtggagactctgcccaactggcgctatgtcgacacacagctgccggtgcgggaagatttttcagtgcctacagaaggggctgaatcgccctggggtggcgcacaactgacgtttatcgcccgccgcgatgttacgccacagccaccacaaacgccgcaagcgttgctggagtttgctaaagccaatcctggcacggttacctatccgcgcccgccagactttaccggcacggcgtttcttgaacagttgctgattatgctaacgccagatcccacagcattaaaagaagcgccggacgatgcgactttcgcccgcgtcactgcgcccttgtggcaatatcttgatgcactgcatccgtatttgtggcgcgaaggaaaggatttcccaccttcgcccgcgcggatggatgctctgctgaaagctggcacattgcgcctgtcgctgacctttaaccccgcgcatgcgcagcaaaaaatcgccagtggcgatttgccggcaagcagttacagttttggttttaacgaggggatgattggcaacgtgcattttgtcaccattcctgccaacgcgaatgccagtgctgcggcgaaggtagttgccaatttcctgctctcacccgatgcgcaactgcgtaaagcagatcccgctgtctggggcgatccttctgttctcgatccgcaaaaactgcctgacgggcagcgcgaaacattgcaatcgagaatgccgcaggatctgccgccggtactggctgaaccgcacgcaggttgggtaaatgcgctggaacaagaatggctacaccgttacggtacgcattaatctttttgctgtgggcgatgatggcggtgatttatgcaccgctgatcccggcagctctcacgctgatatcgcctgctttgtcgttgacacactggcaggcgttatttgccgatccacagttaccgcaggcattaatggcaacgctggtgtcgacaaccatcgcggcggtcggggcgttgttgattgccctgctggtgattgtggcgctgtggcctgggccgaaatggcagcgtatgtgcgcccgtctgccgtggctgctcgccattccccatgtggcttttgccaccagcgcccttctgctctttgctgacggagggctgctttatgactatttcccatatttcactccgccaatggacaaattgggtattgggctgggcttcacgctggcggtgaaagaaagcgcatttctattgtggatcttagcggcagtattgagcgaaaaacggctgttgcagcaactcattgtgctggattcgctgggctacagccgctggcaatgcctgaactggctactgttgccctccgtcgcgcctgcgctggcaatggcgatgctggcgattgttgcctggtcgctgtcggtcgtggatgtggcgattattcttgggccaggtaatccaccgacgctggcagtaattagctggcagtggttaactcagggcgaagccgatcaacaaacgaaaggcgcactcgccagcctgctgctgatgctgttactcgccgcctacgttttgctgggctatctgctatggcgtagctggcggcgtactattccccgcgtagatggcgttcgtaagcctgccacgcctttattgcctggcattacgctggcgagtcttttacccttaaccggtgtgctgtgtgtggttctgctggcgatcctcgcggatcagtcgacgatcaatagtgaagcgctcatcaacagcctgacaatggggctggtggcgacattcatcgctttgctcctgttactgctgtggctggaatgggggccacagcgtcgccagttgtggctatggttgcccattttattacccgctctgccactggtggcgggccagtacacgctggcgctatggctaaacctggatggaagctggacggcggtggtctgggggcatctgctgtgggtaatgccgtggatgctgtttatcctgcaaccggcctggcagcgcattgattcacggttaattttgattgcgcaaacactgggctggtcgcagtccaaaatcttcttttacgtgaaatgtccgcttatgctacgccctacgctgattgccttcgcggtgggattttcagtcagtattgcacagtatatgccgacgctgtggctgggcgcggggcgttttccgacgctcaccactgaagcggtggcattaagcagcggcggcagcaacggtattctcgccgcccaggctttatggcaactgctattaccgcttattatttttgccctgaccgcgttagtcgcaaaatgggtaggttatgtcagacaaggactccgctaatgctctgcgtgaaaaatgtttcgctacgtttaccagaaagctgcttgctgacaaacgttaactttacggtggataaatgtgacattgtcacgttaatggggccgtctggctgtggaaaatccactctgttttcatggatgattggtgcgctggccggacagttttcttgtacaggtgagctatggctcaatgagcaacggattgacatgctacccaccgcagagcgtcagattggcattcttttccaggatgcactgttatttgaccagttcagcgtcgggcaaaatttactgctggctctgccagcggcactcaaaggtgttgcaaggcgcgatgcggtaaatgatgcgctggagcgtgcggggcttggcggtatgttccatcaggatcctgccactttgtctggcggtcagcgagcgcgcgttgctctgcttcgcgctcttctcgctcagccaaaagcgttgctactggatgagccattcagccgtcttgatgtagctctgcgcgataattttcgcaagtgggtatttagcgaagttcgcgccctggcgatccccgtcgttcaggtaacgcacgatctccaggatgttcctgctgatagttctgttctggatatggcgcagtggtcagaaaattacaacaaactgtgataacgcaaagtttttctcaatgcgtcagttcagaatggcgcactcaaaactacaatgtcgggattttcgatgaaacgtgtttctcaaatgaccgcgctggcaatggctttagggctggcttgcgcttcttcgtgggccgctgaactggcgaagcctcttacacttgaccagcttcaacaacaaaatggcaaagcgatagatactcgccccagcgcgttttataacggctggccacaaaccttaaatggcccttctggtcatgaacctgccgccttaaacctctctgctagctggctcgacaaaatgagcaccgaacagcttaacgcgtggatcaagctacataacctgaaagccgatgctccggttgcgctgtacggtaatgacaaagatgtcgatgccgtcaaaacgcgtctgcaaaaagcaggttttacgcatatctccatcctgagtgacgcgctaagtgaaccttcccgtctgcaaaaactgccgcactttgagcagctggtttatccgcaatggctgcatgacctgcaacaaggtaaagaggttacggcgaaacctgccggtgactggaaagtcattgaagcggcctggggcgctcctaagctttaccttatcagtcatattcccggcgctgactacatcgataccaacgaagtggaaagcgaaccgctgtggaacaaagtttctgatgaacaactaaaagcgatgctggcaaaacacggcattcgccatgacaccacggtcattctgtacgggcgtgacgtatacgctgcagcgcgtgtggcgcagataatgctttatgccggcgtgaaagatgtgcgcctgctggatggcggctggcaaacctggtccgacgcgggactgcctgttgagcgcggaacgccaccgaaagtgaaagcggaaccggatttcggcgtgaagatcccggcacaaccgcaactgatgcttgatatggaacaggcgcgtggactgctgcatcgccaggatgcatcgctggtgagcattcgttcgtggccagaatttatcggtacgaccagcggttacagctatattaaaccaaaaggtgaaatagccggagcacgttggggacacgctggtagcgactcgacgcatatggaagatttccataacccggatggcaccatgcgtagcgccgatgatattaccgctatgtggaaagcatggaatatcaaaccagatcagcaagtttcattctactgcggcaccggctggcgcgcgtccgaaacctttatgtacgcacgagcaatgggctggaataacgtctccgtttacgacggcggctggtacgaatggagcagcgatccaaaaaatccggtagcaaccggtgaacgcggcccggacagcagcaaataacattgcaattactgacgctggagcgacttcagcgtcagatacccactccacacccgcgtaaaggtcgtcatccagcacaacgcaccgaagatccacgcaaaccacgcaaaccatgcagggaataaacatcccagcacaaacagtaagatcgtttcagtgccttcggttaatccccccagatagtaaaacgacttatgtgcataaccggggttatcaatctgatgttttgctgccagtgcagcaaaggcgagaaaactgctgcccgtaccgataaacgcaaacaacagccagccgcctgccagcgcattttgctgcggtgcggcgaggataaacccaaaaggtaccagcgcgtaaaaaagaaaatcgagagaaatatcaagaaagccgcccgcgtcggtaagccctctgcgccgcgccagcgcaccgtccagaccatcaagcagcctgttcaacaaaatgacgacaagcgccgccagataccagcccagcgccagaaaaggcagtgccagcacaccgatggcaaatcccactaatgttaaaccatctggcgtaatgcccggtttatcaagaacccgcacgcactgatgcaacaacggtttaatccggggatgaagatggcggtctagcacaggcactccttaaatataaaacctttctgattgagcaacagtgcggatattatggcatttttcgcttatctgcccgtgtgtaatttatgaaaatgattgaagttgttgccgccatcatcgaacgtgatggcaaaattttactcgcgcaacgccccgcccatagcgatcaggcgggattatgggagtttgccggtggtaaagtcgagccggatgaaagccagcggcaggcgctggtgcgtgagttacgcgaagaactgggcatcgaagcagctgtgggtgaatatgttgccagccatcagcgagaagtttcggggcggattatccatcttcatgcctggcacgtacccgacttccacgggacgttacaggcacatgaacatcaggcgctggtctggtgctcacctgaagaggcgctgcaatatccgctggcccctgctgacattccactattagaggcatttatggctttacgcgccgccagaccagcggattagtgctaagggttttgtcatcccgctggcattgcagcagtattccttcggctttaattaccgccccttcagaataattttgatcctgataaacgcagcactgagtacagggctgcgctgactgcccgcctgaactgaacacttctggcggtacgttcacctccacgtccggacgataatgcgggttagccagtgcaattaatggaaatgctaatactacagcgaacaatgctcgactcacagggaactccttaacgttattgtctctgctactaataacggtagccgggcggcataactttagcgactgagttatcgcatttggttatgagattactctcgttattaatttgctttcctgggtcatttttttcttgcttaccgtcacattcttgatggtatagtcgaaaactgcaaaagcacatgacataaacaacataagcacaatcgtattaatatataagggttttatatctatggatcagacatattctctggagtcattcctcaaccatgtccaaaagcgcgacccgaatcaaaccgagttcgcgcaagccgttcgtgaagtaatgaccacactttggccttttcttgaacaaaatccgaaatatcgccagatgtcattactggagcgtctggttgaaccggagcgcgtgatccagtttcgcgtggtatgggttgatgatcgcaaccaggtacaggtcaaccgtgcatggcgtgtgcagttcagctctgccatcggcccgtacaaaggcggtatgcgcttccatccgtcagttaacctttccattctcaaattcctcggcttcgaacaaaccttcaaaaatgccctgactactctgccgatgggcggtggtaaaggcggcagcgatttcgatccgaaaggaaaaagcgaaggtgaagtgatgcgtttttgccaggcgctgatgactgaactgtatcgccacctgggcgcggataccgacgttccggcaggtgatatcggggttggtggtcgtgaagtcggctttatggcggggatgatgaaaaagctctccaacaataccgcctgcgtcttcaccggtaagggcctttcatttggcggcagtcttattcgcccggaagctaccggctacggtctggtttatttcacagaagcaatgctaaaacgccacggtatgggttttgaaggaatgcgcgtttccgtttctggctccggcaacgtcgcccagtacgctatcgaaaaagcgatggaatttggtgctcgtgtgatcactgcgtcagactccagtggcactgtagttgatgaaagcggattcacgaaagagaaactggcacgtcttatcgaaatcaaagccagccgcgatggccgagtggcagattacgccaaagaatttggtctggtctatctcgaaggccaacagccatggtctgtaccggttgatatcgccctgccttgcgccacccagaatgaactggatgtagacgccgcgcatcagcttatcgccaatggcgttaaagccgtcgccgaaggggcaaatatgccgaccaccatcgaagcgactgaactgttccagcaggcaggcgtactgtttgcaccgggtaaagcggctaatgctggcggtgtagcaacatcgggcctggaaatggcgcaaaacgctgcgcgcctggggtggaaagccgagaaagttgatgcgcgtttgcatcacatcatgctggatatccaccatgcctgtgttgagcatggtggtgaaggtgagcaaaccaactacgtgcagggtgcgaacattgccggttttgtgaaggttgcggatgcgatgttaagccagggcgtgatttaagacaattgtgccggatacagcgcaaacgccttatccggccataaaaatcttcagtatcagatggttgaaagaacctttatattatcactccattgcccgcctcttctgatggcgggctttttttcggcgctctcttgcgtggcgaatcctttttcttcccttctccaccgccgggagccattattccccgaaactgccttaccgacgtgcgctttgcctgatcaatcaactggtacaatgtccccaccagcggctgcataaagtcctgatagcgacactgcttttcactgatttgcgtcagcaccgattcccagtgcgcggtcatgtccggtcgcgtcgccatttctggcagcgaatggaatagcgcttttccggcgtcggtggagtggatatagcgcccttttttggtcaggaagcctcgcttgaacagcagttcaataatcccggcacgggttgcttctgtccccaggccatcggtcgcacgaaggatctttttcagatctttgtcctgcacaaagcgcgcgattccggtcatcgccgaaagcagtgttgcatcggtaaaatgacgcggcggctgggtttgccgctctaccacttcacctttttcacacagcaactcatcgcctttcgccaccacaggcaatggcgtaccgtcgttttcttcatcgcgctctttgctgcctaacagcgtgcgccagcctgcttcagcaagaaaacgcgctttagcgacaaatttgcctttggcaatatccagttcgataacacacttgcggaacaccgcatccgggcagaactgcatcaagtactgacgggcaatcaggttatagaccttcgcttcgttctccgtcaggttgatcgcagaactccgtgcggtcgggatgatggcgtggtgtgcatcgacctttttgtcatcccagcagcggttgcgtatatctggatcgaccactggctgcggcaacagatctggtgcatgaacgctgatggcattcatcaccgcgtggcgtccggcaaaatgttcttctggcaaatagcggcaatcggaacgcggataagtgattagcttgtgcgtttcgtacaacttctggcaaatatcaagcacgttctgcgcgctcagaccaaagcgttttgccgcttcaatctgcaacgccgaaagagaaaacggtagcggtgcggattctgattcccgtttatcgttatagctggtgacaatagccggttggccgctgatgcggttgaccacatgctccgccagcggacgatgtaacaagcgcccttcttcatcctgataaggttcacacgcttcgctcggttgccagatagcggtaaaccgctcatcggcaggtgtcacgatatgcgctttgacttcaaagaaatctttcgccacgaagttttcaatctcttcgtcgcggcgcactaccagcccgagcacgggcgtctgcacgcgtcccacggaaagtacgccctgataaccggcattgcgaccgagaatagtatacgcacgggtcatattgatgccgtacagccagtcggctcgggctcgcgccagcgcagaaacgcacagcggtacaaactcactgttggaacgaagacggtcgatcgcccgctcaaccgcctgcgggttcaggtcgtttatcaagcaacgctgcacctgctggcgcttttccggtgccagttgcagatagtccagcacttcatccaccagcaattgcccttcacgatccgggtccccggcgtgaacgatttcgctggcttcatgcaggaagcgtttgatgacgttaagttgtttggtcacggagggtcggggctgtaattgccacttttccgggacaatcggcaaatccgcaagattccagcgcgcatagcggctgtcgtaggcgtctggctgcgcctgctcaagcaggtgaccgatacaccaggtcactacctgaccattaccgcactcgataaagccatcgcctttccggtgcggtttgggcaggacatcagcaatggcgcgcgccagactcggtttttcggcaataaacaaccgcattgaattaacggatctcaaccatggcacgaccgccgcgcgctggcaccagttcgccaatcgccgtcagttcaatgccaaactcggcggctgtagctttaacctcattttctgcttccggcatgaccgccagcagcaaaccgccagaagtttgcggatcgcacagcaaatcgcgcacttcacgcggcatttcacccatcagatgaccgtagctggcaaagttacgttcggtgccgccaggcactgcgcccaacttaatgtactcttcaacccccggcagtttcgggatcgcttcatagtcgacgcgcgcctgcacaccagcaccctgacacatttcgcttaaatgccccagcagaccaaagcccgtaacgtcggtcatcgcttttacgccttcgatgttggcaaaggacgcgcctgcgatgttcatccggcacatcacttccgtcgccagtccctgatgttctggtttcagcaatgattttttctcagccgtagtaagaacgccgatccccagcggtttcgtcaggaacagtttacatccggcttgtgcggtactgtttttcttcacccgctcggtcggtacgatccccgttaccgccagaccaaaaatcggctccggcgcatcgatggagtgaccgccagccagcgcaatacccgcctgacggcatgcatagcgtccaccttcggttacttcgcgggcaatttccggggaaagtttgttaatcggccagccgaggatcgcaatcgccataatcggtttgccccccatcgcgaagatatcgctgatggcgttagtcgccgcaatgcggccaaaatcgaaaggattatcaacgatcggcataaagaagtcggtggtactgataacgctggtgccattgcccagatcgtacaccgccgcatcgtcgcgggtttcattacccacaagcaaattcggatcaacaaacttcgcctgctcactgtgcaggatggtttccaacacttttggggaaattttacagccgcaaccagctccgtggctgtattgggtcaaacgaatcgagttctcgctcatggacatctcctgtcaatgcaatccgggtatggtaaccctcattccatgaagtgataagtgagagtgtctgaattcctgcgcctttgctcacaatccagacagtttcgcgacaattatcagaaataagttacaaacggcgtcgggtccgggacgtttatcgacgtagatgctttcagctgcggcgtaccaaggtagagaaaaccgacaattttatcctgctcacggcaaccgaatgcttcacgcactaccggactttcagttaatgcgccactgcgccagatgccgccaaacccctgggcaactgctgccatttgcatcgccatgaccgcgcatcccgcagacatttcctgttcccagcgcgggactttatgattttcttcgcattttgccaccaccgtgatgatgagcggtgcgcggtacggcgcattacgggctttgtcgatggctttgtcatcactaccggcagcaatcgccccctgctccagaacggcgctgaaacgctcgcgtccttccccttcaatcacaaaaaaatgccacggttgcatggacttatggtccggcgcacgcatacccgctcgcagtatgttttgcagttgttcacccgttggcgcaggttcagccaggcgggaggcgctacggcgattgatcaatagttcgagtgcatccatttgattaactcctgtcatgatatttattcacaaaattaacacgagagtggattttgttacagcacagtccgcaattcctgctgacaagtgccggttgggtcattacgataaccacatctattgcgcctgtgacaggtgtgaccttaagttgggagaatacatgcgaaccctttggcgatttattgccggattttttaaatggacgtggcgtctgctgaatttcgtccgtgaaatggtacttaacctgttctttatttttctcgtactggttggtgtggggatctggatgcaggtcagtggtggtgattcgaaagaaacggccagtcgtggcgcgctgctgctggacatttctggtgtgatcgtcgataaacccgacagttctcagcggtttagtaaattaagccgccaactgcttggtgccagttccgatcgtctgcaggaaaactcactgtttgatatcgtcaataccattcgccaggcgaaggatgaccgcaatatcaccggtatcgtgatggatctgaaaaacttcgcaggcggcgaccaaccgtctatgcagtacatcggcaaagccctgaaagagtttcgtgacagcgggaaaccggtttatgccgttggcgagaactacagccaggggcaatattatctcgccagtttcgccaataaaatttggctgtctccgcaaggcgtggtggatctgcacggttttgctaccaacggtctgtactacaaatcgttgctggataagctgaaagtttccacccatgtgttccgcgtgggtacgtataaatctgccgttgaaccgtttattcgtgatgatatgtcaccggcagcccgcgaagctgacagccgctggattggtgagctgtggcaaaactatctgaatactgttgccgctaaccggcagatccctgctcagcaggtattccctggcgcgcaagggttgcttgagggtttaaccaaaaccggtggcgataccgcgaaatatgcactggaaaacaagctggtcgatgcactggcatcgagtgcggaaatcgaaaaagctctgaccaaagagttcggctggagtaagactgataaaaattatcgcgccatcagttattacgattacgcattgaaaacgccggcagataccggtgacagcatcggtgtcgtcttcgcgaatggcgcaattatggatggcgaggaaactcagggaaatgttggcggtgataccactgcggcacaaatccgcgacgctcgccttgacccgaaagtgaaagcgattgttctgcgtgttaatagcccaggtggcagcgttaccgcgtccgaagtgattcgcgctgaactggctgccgccagatcagcgggtaaacctgtggttgtgtcgatgggcggtatggcggcatctggtggttactggatttccacgccagctaattacattgtggctaaccccagcaccctgaccggttctatcggtatcttcggcgtgatcaccaccgtagaaaatagtctggattcgattggtgttcatactgatggtgtatcaacttcaccgttggcggatgtttctatcaccagggcactgccgccggaagcgcagcagatgatgcagttaagcattgagaatggctataaacgctttatcacgctggttgctgatgcgcgtcattcgacgccggagcagattgataaaatcgcccagggccacgtctggaccggtcaggatgcaaaagctaacgggctggtcgatagtctcggggatttcgatgatgcggtcgccaaagcagcagagctggcaaaagtgaaacagtggcatctggaatactacgttgatgaaccgaccttcttcgacaaagtgatggacaacatgtctggttctgtccgggcaatgttgccagatgcgttccaggccatgttacctgcaccgctggcctcggtagcctctaccgttaaaagtgaaagcgacaagctggcagcgtttaacgacccacaaaaccgttatgcgttttgcctgacctgcgccaacgtgcgttaagtcttgtactaagtggccgacagatcgtcggccacattttttttacctcgacgaatcctcttcccgctgtctcgccccatatttccttatccgcatagtatcaggtgcgctccccctgcctcacgtatatacttttgctctttcgatatcattcatatcaatatcatgcaaaagaaatcaatttacgtcgcctacacgggcgggaccatcgggatgcagcgttccgagcagggttatattccggtgtcaggtcatctacagcgccaactggcgctgatgccggaattccatcgcccggagatgccagatttcaccattcatgaatatacgccgctgatggactcttcagatatgacgccagaagactggcagcatattgctgaagatattaaagcgcattatgacgactatgatggttttgtcattctgcacggcaccgacacgatggcgtataccgcctctgcgctgtcgttcatgctcgagaatctcggtaaaccggtcattgtgacagggtcacaaatcccgctagctgagttacgctctgacggacaaattaatctgctgaatgcgttgtacgttgcggcgaattatccgatcaacgaagtaacgctcttttttaataaccgactttatcgtggcaaccgtaccaccaaagcccatgccgatggttttgatgcgtttgcctctccaaaccttcctccgttactggaagcaggtatccatattcgtcgtttgaatacgccacccgccccgcacggtgaaggggaattgatcgttcatccaatcaccccacaacccattggcgtagtgacgatttatccggggatttctgctgacgtcgtgcgcaattttctgcgccaaccggtgaaagcattgattctgcgctcatatggcgtgggtaatgcgccacaaaacaaagccttcctgcaggaattacaagaagccagcgatcgcggtattgtggtggtcaacctgacacaatgtatgtccggtaaagtgaacatgggtggttatgccaccggtaacgccctcgcccatgccggcgttattggcggtgcagatatgactgtagaagccacactaaccaaactgcattacctgcttagccaggaactggatactgaaaccattcgcaaggccatgagccaaaacctgcgcggcgaactgacgccggatgattaaggagactgcaatgccccctcgcgccctgttactggtcgatttacaaaatgatttctgtgctggtggcgcgctcgccgtgccggaaggtgacagtacggtggatgtcgctaaccgcctgattgactggtgccagtcgcgcggtgaagcggttatcgccagtcaggactggcacccggcgaatcacggcagttttgccagtcagcacggtgtagagccttatacgccaggccaactcgacggtttgccacaaaccttctggccagatcactgtgtgcagaacagtgaaggcgcacaattacatccgttactgaaccaaaaagcgatcgcagcggtgttccataaaggcgaaaatcctttagttgacagttacagtgccttttttgataacggccgtcggcagaaaaccacgctcgatgactggttacgcgatcatgaaatcgatgaattgatcattatgggcctggctactgactattgcgtgaagtttaccgtactggacgcgttacagttaggttataaggttaatgtgattaccgatggttgtcgtggtgtgaatatccagccacaggacagtgcgcacgcgtttatggagatgtcagcagctggggcaacgctatatacgctggcagactgggaagagacgcaggagtaattttatgctggcctacaattctgtactgccattgtaggccagataaaacacgtcagtggtacatctggcaattgacgccatcaacgaaagatttaattcacctcagaaatctcttccaatgacaccttccgcgtttcgatgccaaaaatggagagaaccagcgcacagagcactaacatcacgccaagcactataaacaccgtgattgacccataatgcgttaatagtgccgcaacgccataaggcgtgaagaccgcgacgatccgtccgacggcattaacgaaacctgaaccgcgcaggcgtaaatgcgttggccaaagctccgggatataaaccgccgacgcgaagcaaacatacatgtataaaaagaagatcatcaccaggccatagattaaaatcgcccactctgtagtctgaattgaatagatatagcctaacacggcaataataataagcaaggcggaaccaaataatcgacgagggaaatgatcaataattaatgccgcaataaatattcctaccggagcgccaatcataataacagcagtcattaatattgatttatcgacatcaatgccggagttaacaaatatggtcggtatccatacggtgatggtataaagtgaaatattcattgcaattaaaacagtaatcgcgactaatgtacgtcgtaacatttcccctttaaacagcagccagaaagtaccattgattacgttagccttgctgttgctctgattcaaagtaagcgggggtaaacgaacactcttctctctttcaatttgctgctctacttcacgaagttggctttctgcacctgcgatttgtcctttacccgccaaccatcgaggcgactcaataaagtatttacctgagagaaaccaggctaacagtatgccaataccacccagcagaaacattatccgccaactaaaaaaagcgataaccaccacgcctatcgccgcagacaacatgggcgaccagttaccgacaaatgagagtcgcgcggaccattttccacgcaccgtcgcggggataaactccgtaaacgaagcatagccaaccataatcagcgcccccattcctgtgcccatcaggaagcgaaagaagatgagccagtacatatcagggacaaaagcggcccctgttgccgcaataccgacgatgagaagatttatgcgaaaagccctgcgccgcccaaaataatcaccgatgaacccaccggtaagagagccgatgaaataaccaaacattaatgccgaggtaaaggcggcattgaggaaattatttgaccatccattgcttaccagctttgctaaaacaacattgcctgaataactcaaaaaacccgttaataacagactaaagcttataataccaaatatacgataatgaaaccgggccaaaggcaagcggtccagtcttgcgccaatttgatcatattgttccattaggtgcctcggatttgctaaaaaggtagcaattgcggcaaattcacttgccgcatctttatcatcattttattttccaggcgcaggaacaaataatattgacaacgtgtgcttaaattaccacaccagctggatattattgtctttgcaaaatgctatccactctgcacccggtgatttatcagttattatgtaattaatatgactaaagtcagctaactggacaaaagctttgcgatcaaacttagagtgatcaaccaataacgctacctctgtcgcctgacggatcattgtctttttgatttcagcttccgcttcgttagagtccagcgcgccgctgttaatatctagacctttacaactcattaccatgatatcgacatggtagcggctgatgatctctttagtaattcttccttgcagggaaagtgtatttttgtttagttccccacccgttgaaacgactttaatttctgactgagccagaacatgaatcgcttccgccgagttggttagcaacgtcaggtcactacggtcctgtaacaatttgagcaattccattacggtactactggaatcggctgccatggtggttttattgtcgataaagggtagtgccttgcgtgcaataagctgcttctcttcataaaacgatgaagcacgcttataaaaatggatattctccgtcaacatcgctgtatttaaaacagcaccaccataggttctggtcaaaaagccttcatcttccagcttctcaagatcgcggcgaatggtttcttcggttacctgaaaaatcccactcaaatttgagactgtcacctttttatcgttggcaaccatttgcttaattgcctgaatcctgtcttttgccgccacgattacacccctgtatctttttacatcacattagcgtgattatcgcataaccgatgtttactttcaaaatagcctgtttgaatcacagattttcatcacagttttcacagaaacagaggtgaatcgtgttgagtatttaacgctccagggcctctgccatttccctcatcaatgttgcgtctgcatccgataagttgatattcaatgccgcgacattttcgcgtacctgttccggtgcagtagccccactaagaatggagattaaatcactctgttttaatatccacgccagtgccagagtgggaattgtgcactgataacgagcacagagtggctgccactgttcaagcatatcaatcactttcagcatgttttcacgctggaaccagactttatttgcccgagcgccgcccggaacgtaatcacgagtgatggtaccggtcaacaatccctgctctaacggggaataaacctgtaccacaatgccattatcacgacatagcggcagcagttcgctttccattgcccggtcgaggatactgtatttcgcctgaataatatccagttcaccatattgcagatactcgcggatatggtcagcatcgacgttagcagcgcctatagcgcgaattttcccttcggcctttaactcattgagcactgcgacagtttcagcgatcggcgtaaaaaatggcggcaccgactgccagtgcgtcatgtagatatcgatgtaatcaatacccagacgttgcaagctggcttctacctcttcgcggatagattccggggaaaggtttttatacaactgccgatcgccaactttgttgaataaacttccttttcgttcccagacaatgccgcatttggtttctactacaacctgttcacggggcagtttttttaacgcctgaccgacgataacttcactattgccaaagttatatcctggcgcagtatcaatcagattaatgccacaacgatgggcttcaagaatcgtatcaatacatatttgctgatcgagatcgccattccatgcaggaccgccgccaatggcccatgtccccaaccccattcgcgaaagcgtaatatccgttgtgcctaaaggtatctttttcatttgccttcattatccttcgtattcttccagcaattgttcgaccagctttctgttttttacgccggtggtggcaccgacgcttagaaccgagatagccgccgttgcattggcaaagcgtgcgcattcacgcagatttttgccttctaacagtgccgcaataaaacctgaagcaaagttatcgcccgcgccaatggtgtcgatggcggttattcctgcgaccgccggcaccttcatcgtcatgtcaccacgcttgataaagcagccgtctttacccgttttaatcaccaccgtttttacgccgcacgcaagaaagcagtcagcaatttcatccagtgtctctttcccggtgagtaattttgcctcggcaaaattaggaaacagataatcgacaaaactcaatgcttcgcaaatatcatccagcgtttcattcaaccgtggtttgatcatatcggcacagataatcatctgccgggctttagcttgcgtaaaaatttctgttagcgctttaccatccaatagaggactgttgaaaatactggccagtgataataatttcgcctgagaaaaccgcgcaaaatcaacatcgtcaatattcaatttccacagactgccgttacggtttgtgacaaacgtccgctcgccatcctccgtcaccagtccaacgttaatagaggtatctatgctgacgtcctgcttcaggctttgaatatcaatattctctttgcggcaatggtcgagaataaattgtcctgcggcatctttaccaacacgactcattaatgctgtgcgatggcccagacgagaaataattgttgcttcatttattgcatcacccccggtggtcattgcgattctttcaagaggataagaatccacatcaaagatatttttactgaccggttgcaatggaatatcaacaatagcggcacctatacaaataacgtcgagattatccatatcattattccgctttgccatcagaaccgaacagtttaattttttccaatgcccgttcttttacagctttacgtacttcacgttctaaatgcaggaaaggctgatcctggttttctttcactgctaccattgcggcctgacagagctccgtatgaatgttgattttcgcgatacccaacgaaattgcagttttaatgtcggtatcactgatccccgatgcgccgtgcaaaaccagcggaacagaaacggcatcgcgtacgcgtttgacgacctcaaaattcaattgtggctctgacgtataaaccccatgttggttgccgatggcgacagccaatgagtcacagcccgtacgttcaacaaattcagccgcctggtcaggatcggtatagtgatagcccgccagcgcttcttcataaacggtttcattaccgacatgccctaattctgcctctaccggaatacccagcggatggaagaaatcaacagcctctttggttaaacgaatattttcttcgaaatcaaatgcggaagcatcacgcattaatgaattcataccatgagtccaggcgttatgaataatttccatactccgaccatgatcccaatgagttattaccggcaccgttgctttttttgccattgataccatcatgtgagagaaatcttcaaatgaggtgttcccgacaaaacctgtaccaaaagaaataataaccggtgatttcgcttcttcggctgcgtcgataacgcccatcaacatttctgcattccatacgttaaaatgggcaattgcataatgtttatttgtggcatcgttttcccaatatctgatatctgcgagcatattctgttctcccgtattaattaatcgctaattttaataacgcctttaataatgtcgcgtttgttgttaaccgactcttcaaatgcctgttgtacatcctgataatcgtaaatatgtgtcaccatcgatttcacatcgaatcgccctgaggaaatagcttcaatcgtgaccggataacgattggcatagcggaatactgtctgaatagtgacttcgcgattgattttgaggaaattgattgccgaatcgcccggtacagtaccaacaatcataattttaccgccgcgcattaccagataaggtgcctgtttaacggtgaccgcagaacccgctgtttcgaaaacaatatctgcgcccatttcttcggtaaattgctgacagcgtgcaatagtgtcttcttttgcaccgttaataaccactgtcgcgccgagctgttccgccattgtcagacgtttatccagtacatcaacgacggcaatatccgtagctcccaggcatttgcacgcttgcaacgtcatcaaaccaatacaacccgctcccagaataattatcttcttacccggtttaacatctgccagcatcgcggcatgcatcccgactgcagcaggctccaccagcgccccttccatcatgtccatattgtcgggcagtttgtaagtaaagctctccggatgacacagatagtgcgttaatgcgccgcggtagttaggttgtgtcgccataaaatcaacgtccgggcagatgttatatttgccttccagacagtaacgacagtgaccgcaaggaacgccaggttcgatatttactcgatcccccggtttaaatttgcgcactcggcttcccacagccacaaccgtcccggcgcattcatgacccaggccaatttcttgatttgggtctttaggcggaataaacgggcctgattcaaaaccatgtacatctgaaccacaaataccgacatattccactttaatcaaaacttcatcttctttaggcacaggtatttctgctgaaataattttcattgtgcccggcacctgcaatattgcttttgaatttttcattttgaatccaccagtattatttattgactactgcatcaatacttaaactttcaacggagacacctttggtttcaattccaatggtggcgatagcaattgcgacaataattgaaaccgcccccagaagaataaagactcccgttacgccataactactgagcagcactgcaacggcataaggtgcggcaataccactgattcgccctactgcattcgccagaccggagccacgtaatttggcctctgtcggccagatctcagggacatacactgccgaggcatagcaaacgtacatatagacgaaagtaatcaggaagaaaccaatcagcgttatgagcaacatactggtttgcagtgaatagatatatccgagcaccgcaatcaggattaatagccccacacccattgttttacgcggaattttatccatcaccagcatggcaataaaaataccaaatggcgcgccaaacatactcatggtatttaaaacaatcgagtcttttaaattaatcccctgggtcatgaatatcgttggcaaccagttaattagtgtgtactgcacaacgttcatggcaatcagcacacaagaacctaatatcacgcgtttcagtaatactcctgtcagtaaggctgaatacggcaccgcttgtggcgctttaccgtcatcagcaataaccacgggcggcaaaggttttcccgtctggcgtatgacgccttcttctatactccgcatgactttctcggcttcctgataccgtccgcgcgattccagccagcgcggggattcaggaaagtagcgccaggccagcgccgtagcgataagcgacaatattgcagggataagcagttgtactcgccagttccactctgcactaatcagcggcgtgagtcccatcgcaatcaatgaacagagcggatatgaccagttgccaataaaagaaacccgactggaccacgttccgcgatttctaccgggcatatattcggtgaaaccagcaaacagcgtcaccagtaaagctcccagcccaacgcccatcacaaaacggcaggcaataaggaaatccatattcggtgaaaaagcaccgaccaccatcgaggcaatatgaatggcctcatagaggatgaacgcatttctgcgaccggttttgtcaccgatgatgccgccaaccagcgcaccgagaaacattccggcggtcgtgattgctgagaatgtggcagtggtggaattatctgtccagcccaactctttcagctgcgcgaggatcaagccaccaacggcattactccagcagacaagcaagccaaacgagacgatggcaaacattgacgaatgccagcggcaatccggtaagcgatccagccgtgcaccacaatgcggttttgttatctgttccatgcgataacgttccttcaggagagtagttattcatcaaagtcgtaagtcatgatcactttgattgcggttttatcgaccatcgcatcaaacccttcgcgccattgcgacaggccgatacgatgcgtgatcatcggtttgactttgatagcgccgctggctaatagccggagagcgttacgccatgaggtggagtcataggccatatgcccaatgatgcttttgttccaggcggtaatgtcattaatcgagaaattaagaggtttgaagcccattccaacgcgtaccacttccccgttcgggcggagcatttcgatggcttgtttcaatgcgatattggcaccggagcattcaatcaccagccccagattgtctttgccacatatttgctggcagcgcgccaccacatcttcggtagaaccatttactactgccgtcgcacccagttcttttgcaaccgggaagcggaccgccacatcttcttgtagaccaacgacgacgatatttaccgcccccataatccgcgccatttgtacggagaacagcccgagtgggccagtaccgatgacgactacatcctgaccagggaggaatttcgattgctgcgcgatggatttgtaggcattacagatagggtcaagtacggctgcgtcctcataatcaacaccatcagggatttcccacaacgcatgacgatgaattttgagaatttcaccaggaaccagacaatatttggaaaaaccaccgccccaggtattgttatccagaccaaggtttactttatctgtacaacacagaaaatcaccttgttcacaggccggacaaacgccgcagacgtgaccgctgttatctgacacgacgcgttgccccactttccagtctttgactttttcaccaacctgcgcaatacaacctgcgaactcatggccgcggatagagttaaactcatcagaaccgctatcgacattgtagtgcttcatgtctgcgccgcagattgccgcggctttaatttcaatcactacatcttccgggccacaaatgggttgtgggacatcgatcatcttgtagccgccaaaggctttgccaaaccgagccagtgctttcattgcgtcatcctctgtgttttgttttgcttagatggtcatcatacttacccacatgatttttgaggtcaacattaaatctgtaaaacacagataatgatctgcgttttacaactcagatcacaattacgcagaaaatggctggatctgttacaggttgatggaaggcggaacgcaaaatgagcaaatttgagagggattaccggccaaataggtctgagacttaagttcaggagaagtcattcaggcgtgaacgcgactgcaagagaccgggctggggctttgcctggtcgtgacgagataattgagatgagtcgtggggttattgttgactatcccctttataaccgcggcaaaaaggggacaaaccacttacttaaacatggcaataggctttgctgagataccaaagtcttcttttaactgttgtttgctcttcatgaccatctgaccatttgtgtcaattgtcatatgctgtgcttcggtattattgcgggcttgccacagcatcaccagttgcaggcagttctctttttgttcctcggtcaacgcaacgccatcaggccatttccccaattcaacggcggtcgacaaacgctggtatacctcaggcgtcatgctgttgataatgtcatcaagattcataatttttccgctcctgtggaataagttgctgaatcgttttttcaaccgttgatttcttcgccgttttcgccatcggtaaagcgtaaagaggctgagttaacacaataacgttcacccgttggctgcggcccgtcggggaagacatgccccagatgggcatcacagttaccgcaacgaatttctatgcgctgcattccatgtgacaagtctttgatataacgaatggattcttcactcaccggttcgtagaaactgggccagccacagccggaatcatacttggtttgggaatgaaacagcggggcatcgcagatcaaacagtgatatacgccgtcacgcttgttatgcagtaaacgacccgtaaatggcggctctgtcccatgattctgcgtcacgtagaactgcatctcggacaaattttttttcagttcttctgccgaaggtttattagccatttgctcacatctcactttaatcgtgctcacattacgtgactgattctaacaaaacattaacaccaactggcaaaaatttgtcctaaacttgatctcgacgaaatggctgcacctaaatcgtgatgaaaatcacatttttatcgtaattgccctttaaaattcgggacgccgaccccatgtggtctcaagcccaaaggaagagtgaggcgagtcagtcgcgtaatgcttaggcacaggattgatttgtcgcaatgattgacacgattccgcttgacgctgcgtaaggtttttgtaattttacaggcaaccttttattcactaacaaatagctggtggaatatatgactatcaaagtaggtatcaacggttttggccgtatcggtcgcattgttttccgtgctgctcagaaacgttctgacatcgagatcgttgcaatcaacgacctgttagacgctgattacatggcatacatgctgaaatatgactccactcacggccgtttcgacggtaccgttgaagtgaaagacggtcatctgatcgttaacggtaaaaaaatccgtgttaccgctgaacgtgatccggctaacctgaaatgggacgaagttggtgttgacgttgtcgctgaagcaactggtctgttcctgactgacgaaactgctcgtaaacacatcaccgctggtgcgaaaaaagtggttatgactggtccgtctaaagacaacactccgatgttcgttaaaggcgctaacttcgacaaatatgctggccaggacatcgtttccaacgcttcctgcaccaccaactgcctggctccgctggctaaagttatcaacgataacttcggtatcatcgaaggtctgatgaccaccgttcacgctaccaccgctactcagaaaaccgttgacggcccgtctcacaaagactggcgcggcggccgtggcgcttctcagaacatcatcccgtcctctaccggtgctgctaaagctgtaggtaaagtactgccagaactgaatggcaaactgactggtatggcgttccgcgttccgaccccgaacgtatccgtagttgacctgaccgttcgtctggaaaaagctgcaacttacgagcagatcaaagctgccgttaaagctgctgctgaaggcgaaatgaaaggcgttctgggctacaccgaagatgacgtagtatctaccgatttcaacggcgaagtttgcacttccgtgttcgatgctaaagctggtatcgctctgaacgacaacttcgtgaaactggtatcctggtacgacaacgaaaccggttactccaacaaagttctggacctgatcgctcacatctccaaataagttgagatgacactgtgatctaaaaagagcgacttcggtcgctcttttttttacctgataaaatgaagttaaaggactgcgtcatgattaagaaaatttttgcccttccggtcatcgaacaaatctcccctgtcctctcccgtcgtaaactggatgaactggacctcattgtggtcgatcatccccaggtaaaagcctcttttgcattacagggcgcacaccttctctcatggaaacctgcgggtgaagaagaagttctgtggttgagtaacaacacaccgttcaaaaatggcgtcgctattcgcggtggcgtaccggtttgctggccgtggtttggtccggctgcacaacaaggcctgcctgcgcacggttttgcccgcaacctgccgtggacgctgaaatcacatcatgaagatgctgatggcgtagcgctgacttttgaattgacgcaaagcgaagagacgaaaaaattctggccgcacgactttacgctgttagcgtatttccgcgtgggtaaaacctgtgaaatcgatcttgaagcacacggcgaatttgaaaccacctctgccctgcatacctactttaacgtgggtgatatcgctaaggtaagcgtcagtgggctgggcgatcgcttcattgataaagtgaatgacgcgaaagaagatgtactgaccgacggtattcagaccttccctgaccgtaccgatcgcgtgtatctgaatccgcaagattgcagcgtgattaatgatgaagcgctgaatcgtattatcgccgtaggtcaccagcatcatctgaacgttgtaggctggaatccgggaccggcgctttcagttagcatgggcgacatgccggacgatggctacaagacctttgtttgtgtagaaacggcttacgcttcagaaacgcaaaaagtcaccaaagaaaaacctgcacatctggcgcaatccattcgcgttgccaaacgttaatttgcgttaatgttgtgtgccgggtgcgatgcatccggcacgtatcaacatcacaccatatccagcgcagtttttccttttggtgccggatacgctttatccagcatagctaattccgctggagaaagttcgacctcaagcacagccgcattctgttggacatgggcaatcgtggccgcttttggaatcgccatcacaccctgatggctgattacccacgccaacaatacttgtgccgagctgatattgtgagcatgtgcaatttcgttgactactgcgttttttagcagcccattgcgcaaccgcccggcctgagctaacggactgtaagccatcaccggtatctgctgttgctggcaccaagggagtagatcgtactcaatccctcgtgaaccgagatggtaaagtacctgattagtggcacactgatttccccccggcagctgccagagttcctgcatatcggcataatcaaggttagaaacgccccagcggcggattttgccctgggcgaccaatttttccatcgctgcgacagtctcttcgagagcgaaactgccagaccagtgtaataagtagagatcgagataatcagtattgagacggcgtaaactggcttcgcatgcatttatcgctttttgcccgccagcattccacggatagactttagagacgagaaagaccttctctcgcagaccggttaatgcttccccaaccaccttttcggcaccaccatcggcatacatttcggcggtatcaatgagggttaaaccgagttcaatgcccgcgcgtagtgcagctacttctgttttgcgctgactggcatcttcgcccatataccatgttccctgccctatggctggcagtgagacatcgccactaaattgaatcattttttgttgcattgtttcctcccaggtattgcaccaccgtaatgcaaaacagggcgtgacgccctgtttttatgcacaaaatgccctggaaagatgcattatcagaatttgtaggtgatcccggtagaaatcaggccagtccaggatttatccaccattgggctgtcagtaacttcatcagacagacgggtgtagcgcgcggtaccgtaaacactccagtcgccgaggaagttgtagctggcgctcagctccaggtaagggctccagctgtcgttcgggttatagccacgcagaccgctgcgagcggactctttgcgcgatacgccataatagtattcgttctggttttcgctgttccactgcacaccaatacccggagtcacggtcaggccaccgttggtgtaacgatacaaccaggccatatcccagacgatgccgttgctgttatccagggtatcgccagccagggtggtacgcaggtaaccgtactgggtaaagtgagcataagacagaccagccatcatggtgctcttacggtcatccaggtgacgcatttggtgatcgccactgtctttcgctttgaagtaaagcggcgaccaataagcggtaattgaaagtttgtccgttgcgtcattccacaggtagtaaccaccacctaagccacggaaccagaagttatcgccttcatagttgattaccggtactgggtagacatcggtatcgtaatctttatatgggtgttcaacgacacctacgcctgcgcccagggaaaatttaccttcagcgtgcgctacgcctgcagacgttgcgataagcactccaagtgccagaagtttgagtttggtcacaattaatcattccttaaacaaatgtttagcgggcgacaaagtttacccgtcaatacatcgaaacccaacctttttacgttttcattttttaaagtaactgtttaattttcctgacgcggatgacaccgcgcttacagccaaatgaatttagcgttactggcgagcctggtctttacattaattatgcaaaatttatggatgagttgttgatatgccattgaaattaagaaagccgtgcaggcaagttttccatttgccatctacgcttaattttgaaggtgtatcaccgggcacgttgttctcatcgtcgataaaatggcatgagagttgctgtgttttagcaagagacgtcgttcagtttacctcttccgggagcctctactattcatatgaacggctcttaacctgtgctaaaaaacgaaaggacggcataccatgaatatattcgatcactatcgccagcgatatgaagctgccaaggacgaagagttcacactgcaggagtttcttaccacttgtcggcaagatcgcagtgcttatgccaacgcggctgagcggctattgatggctatcggtgagcctgtcatggtcgatacagcccaggaacccagactttctcgactcttttctaaccgggtcattgcacgttatccggcgtttgaagagttttacggcatggaagacgcgattgaacagattgtctcttatctgaaacacgcggctcaggggctggaagagaagaaacaaattctgtatctgctggggcctgtgggtgggggtaaatcatcgcttgctgagcgactgaaatcattaatgcagctcgtaccgatttatgtattgagcgccaacggtgagcgtagcccggtcaacgatcatccgttctgtcttttcaatccgcaggaagatgcgcagattctggaaaaagagtatggcattcctcgccgttatctcggcaccatcatgtcgccgtgggcggcaaaacgcctgcatgaatttggtggcgatatcactaagttccgggtagtgaaggtctggccgtcaattctgcaacaaattgctatcgccaaaacggaacccggtgatgagaacaaccaggacatctccgcgctggttgggaaagtcgatattcgtaaactcgaacactacgcgcagaatgacccggacgcctacggctattccggtgcactgtgccgcgccaaccaggggatcatggaatttgtcgagatgtttaaagcaccgattaaagtgctgcatcccttgctaaccgccactcaggaaggtaactacaacgggacggaaggtatctccgccctgccgttcaacgggattattctcgcccactcgaacgaatccgaatgggtcactttccgtaataacaaaaacaacgaagccttcctcgatcgtgtttacatcgtgaaggtgccgtattgcttgcgcatttccgaagagatcaaaatctacgagaaattgcttaatcacagtgaattgactcacgccccctgcgcccctggcacgctggaaacgctgtcacgtttttccattctttcgcgccttaaagagccagaaaactccagcatttattcaaagatgcgggtttatgatggcgaaagtctgaaagacacagatcccaaagccaagtcgtatcaggaatatcgtgactacgccggtgtcgatgaagggatgaacggtctgtcgacgcgttttgcgtttaagatcctctcccgcgtgttcaacttcgatcatgtagaagtggcggcaaacccggtccatctgttctacgtcctggaacagcagatcgagcgcgagcagttcccgcaagagcaggcagaacgctatctggagttcctgaaaggttacttgatcccgaaatatgccgagtttatcggcaaagagatccagacggcctaccttgaatcctattccgaatatgggcaaaacattttcgaccgttatgttacctacgcggatttctggattcaggatcaggagtatcgcgatccggataccgggcagttgtttgaccgcgagtctcttaacgccgagctggagaaaatcgagaaaccggcggggatcagtaatccaaaagatttccgcaacgagattgttaacttcgtactgcgcgccagagcgaataacagcggacgcaatccgaactggaccagctatgaaaaactgcgcacggttattgagaagaaaatgttctccaataccgaggagctgttgccggttatttcgtttaacgccaaaacgtcaaccgacgagcaaaagaaacacgacgattttgtcgaccgtatgatggaaaaaggctacacccgtaaacaggtgcgtttactgtgcgaatggtatttgcgcgtacgtaaatcgtcttaacaaccctggcccggtacacatgctaccgggcctacaacgacagcgaaccgtgggccagagaagcggcaacacaggcgtagcatacagttggcaaatgtagtacggggggcatatgacctggtttattgaccggcgtctgaacggcaaaaacaaaagcatggtgaatcgccagcgttttttacgccgttataaagcgcaaattaaacagtcgatctccgaggccattaataagcgttcggtgactgacgtcgacagcggcgagtctgtatccattcccacggaagatattagcgaaccgatgtttcatcaggggcgtggcggtctgcgccaccgcgtgcatccgggcaatgaccatttcgtccagaatgaccgaattgaacgtccccagggtggcggcggaggttccggcagtggtcagggccaggccagccaggatggtgaaggtcaggatgaatttgtctttcagatttcgaaagatgagtatcttgatctgctctttgaagatctggccttaccgaatctgaaacaaaaccaacaacgccagctgaccgaatataaaacgcatcgtgcgggttataccgctaacggcgttccggccaatatcagtgttgtgcgttcattgcagaactcactggcacgacgcacagccatgacggcgggcaagcggcgggaacttcatgcgctggaagagaatttggccatcatcagcaatagtgaacctgcgcaactgctggaagaggaacgtctgcgcaaagaaattgcagaattacgtgccaaaattgaacgcgtccctttcattgacaccttcgatttacgttacaagaactacgagaagcggcccgatccctccagccaggcagtgatgttttgcctgatggacgtttccggttcaatggatcagtccactaaagatatggctaagcgtttttatattctgctgtatctgttccttagcagaacgtataagaacgtggaagtcgtatacatccgccatcatacccaggcgaaagaagtcgatgaacatgagtttttctactcgcaggaaactggcggcaccattgtttccagcgccctgaaactgatggatgaggtagtgaaagagcgttataacccggcacagtggaatatttacgcggcacaagcatcggacggcgataactgggccgatgactctccgctttgccatgaaatcctggcgaaaaaattattacccgtcgttcgttattacagctatatcgaaattacccgtcgtgcacatcagacactgtggcgagaatatgagcatctgcaatctactttcgacaactttgcgatgcagcatatccgcgaccaggatgatatttatccggtgttccgtgaactgtttcataaacaaaatgcaacagctaaagactaaaactatcagccgggtcattatcgcctggctgatttttagctcactgtaaattatctcatttattacatacattagcttacaatcgctttaaatatgacagcataacctttacacaatttagttccagaaaacaatcattcggaaaaatgattcggtcaacacgtgtttccctggggttattctttaaatattttttatcgttaacgaaaattgatcctggtcaaaactatatatctctgccatcaataaaatccagcactcacattgctctcctttttatggcttctatgggtacacaaaaattaaaagctcaaggcttttttattttcagcttattgctgacgttaattttattttgcattactaccttatataacgaaaacacgaatgtaaaactcatcccacagatgaattacctgatggttgttgtggctttgtttttccttaacgccgtcatttttcttttcatgttaatgaagtatttcactaacaaacaaattttaccaacactcattttaagccttgcatttttaagtggccttatctatttagttgaaaccattgtaattatccataaaccaatcaacggcagtacactgatccagacaaagtcgaatgatgtttctattttctatattttccgccaactcagtttcatttgtttaacctcgctggcgctcttttgttatgggaaagacaacatccttgacaacaataagaaaaaaactggcattctgttactggcactgattccttttttagtttttccccttctggcacacaatctgagcagttataacgctgactattctttgtatgtcgtcgattactgtccggacaaccatactgcgacctggggaatcaactatacaaaaatattggtttgtctgtgggcatttttactgttctttattatcatgcgcacacgattagccagcgaactatggccgttaatagcattattatgtctggcatcgctatgctgcaacttacttctactaactctggatgagtataattacaccatctggtatatcagtcgcgggattgaagtctccagtaaactgtttgttgtgtcttttctgatttataacatttttcaggaactgcaactctccagcaaactggcagttcatgatgtgctgaccaatatttataatcgccgctactttttcaacagcgtagagtcattattgtcgcgacctgttgttaaggacttctgtgtcatgctggttgatattaatcagttcaaacgcatcaatgcccaatggggacatcgtgtgggtgataaagtgctggtttcaattgtcgatattatccagcaaagcatccgccccgatgatattttagcgcgactggagggtgaggtgtttggcttgctatttaccgaactgaatagtgcccaggcaaaaatcattgcggaacgtatgcgtaaaaatgtcgaactcctgaccggctttagtaacagatatgatgttcctgagcaaatgaccatcagtattggcacggttttttcaacgggtgacacacgtaatatctcgcttgtcatgacggaagcagataaagccttacgcgaagcgaaaagcgaggggggcaacaaagtgattattcatcatatttaagtgcaaaaatattcagagccatgctttttgcgtggcttttgcatacaatttattactattacccctaaatttcccctccccagcggcgcagagatgagtataattagcgcccctgtgccaggccgcaatcgaactttatctggttttctcgtttcactaaccgaaggagtgccatttatcatgaaattgcaccatagaatgctccggcattttatcgccgcaagtgtcattgtgctgacatcttccttccttatttttgaacttgtcgccagtgacagagcaatgagtgcctatctgcgctatatcgtgcagagagcagactcctcctttctttatgataagtatcagaatcagagtattgccgcgcatgtgatgcgcgctctcgctgctgagcagtcggaagtgtcgccagaacagcggcgcaccatctgcgaggcttttgagtctgccaataatacccatggcttaaacctgactgcccataaataccctggcttacgcggcacactacaaaccgcatccactgactgcgacacaattgtggaagctgcagcactattacccgcttttgatcaggcagtggaaggcaaccgccaccaggatgattacggttcaggtcttgggatggccgaagagaaatttcactattatctcgatctcaatgaccgctatgtctatttttatgagccggttaatgttgaatactttgcgatgaataactggtctttcctgcagtcaggaagtattggcatcgatcgcaaagatattgaaaaggtatttaccgggcgtaccgttttatcgagcatttaccaggatcagcgtactaaacagaacgtgatgagtttgctgacgccggtatatgtcgcagggcagctaaaagggattgtgctgctggatattaacaaaaacaatctgcggaatatcttttacactcatgaccgccctctcctctggcgttttctcaatgtcacgctaaccgataccgattcggggcgcgacattatcatcaaccagagcgaagacaatctgttccagtatgtcagttacgtccatgacttaccgggcggcattcgtgtctcgttatccattgatattctttactttatcacgtcttcgtggaaaagcgttctgttctggattttgacggcgttaattttgctgaatatggtgcggatgcacttccgtttataccaaaatgtgtcgcgagaaaatattagtgatgcgatgactggactctataatcgcaaaattttaacccctgaactggagcagcggttgcaaaaactggtgcaatccggttcttcggtgatgtttattgcaattgacatggacaagttaaagcaaataaatgacaccctcggtcatcaggagggggatttagcgattacgttattagcgcaggcgattaaacagtcaattcgtaaaagtgattatgccatccgactcggtggcgatgaattctgcatcattcttgtcgattcgacgccgcaaattgcagcacaactgcctgaacgtatcgaaaaacgtctgcaacatatcgcgccgcagaaagagatcggcttctcttccggtatttacgcgatgaaagaaaacgatacgttacatgatgcgtataaagcttccgatgagcgtttatatgtcaataagcagaacaaaaacagccgttcatgataaccttctatggttgtttgcttgtaatctcaggagcatgaaatgactgaaatggctaaaggaagcgtgacgcatcagcggttaatcgctttattatcacaagaaggtgctgacttccgcgtcgttacccatgaagcggtaggtaaatgtgaagcggtgtcagaaattcgtggcaccgctttaggccagggggctaaggcactggtatgtaaagtcaaaggcaatggtgtaaatcaacatgttctggcgatcctcgcggccgatcaacaggccgatctgagccaactcgccagccatataggcggattacgcgcttcgttggccagcccggcggaagtcgatgaactcacaggctgtgtcttcggcgcgatcccccctttcagcttccatccaaaactcaaactggttgccgatcccctactcttcgaacgatttgatgaaatcgccttcaatgcaggcatgctggataaatccgttattttgaaaaccgcggattatttgcgcattgcgcaaccagaactggtcaatttccgccgcactgcgtaactagcctgtccgttcgataagaagaacggacaaaaccagcacaacagcaatggcaaaaaacgatgacgtgataatcagtgtctcgacgaacatttgatcgttcatagtatgcccccgggagatagctgttttcacgttattgttagcgtgcacaaattgcagtttgatgacagttcgcctgattttttatgcaaaaaacgtaaagattttctacttccttcctgcagcaagcgtaaagtaagcaggcttattattttttggcaaggaaaccacgatgtttgatgtcactttgctgatcctgctcgggttagctgcgctgggctttatcagtcataacaccactgtcgccgtttcaattctggtgttaatcattgtccgcgtcacaccgttaagcacctttttcccgtggattgaaaaacaggggctaagtatcgggataatcattctgacgattggcgttatggcccccatcgccagcgggacgctaccgccctcaaccctgattcactcgtttctgaactggaaatcgctggtggcaattgcagtaggcgttattgtctcctggctaggtgggcgcggcgtgacgttaatgggcagccagccgcaactggtcgccgggctgctggtgggcactgttttgggcgtggcgctgtttcgcggcgtaccggttggtccgcttattgccgcgggtctggtttcgctgattgtggggaaacagtagttaatcccgcaatatatcggcctggcgtttgccccaggcctttcttaaacatagtaataaaggccgttgttgaatcataccccagcgtatgagcaactttctgtacagtatcgcctttcactaatccctgaagcgccataatcagctgtaactgctgacgccactggcgaaaactcaaccccgtctctttcactatcagtcgggcaagattgcgttcactcatcgcaaaaaagcgagcccattgccccaatgacccccactcgacgggctctttcgccatcatctccaccatcgcgcgaattttaggatgagaagaaacgggtaggtgcagctgttgttgtggctgctgagggagttcatcaaacaggacctgaattaatctgcgggtcatcggctcagcacgctgagtcgacgtcctgtttgccagggttaaaattaattcccggcataagggcgatattttcaatgtgcaacaggttgtcggcattgtcactgcgctgggttcgataaacagaaaacagagttcagcgttagctgtcacttgattgctatgttccaccccgcccggtatccaaaccgcatattgcggtggcaccatccacaaagcattttccaccgtacaggtaattgcaccatgtagcgccagtatcagctgtcctttgcggtgctgatgtacaggactggttaactcatccgttccggcgtgaatacaaaatgcgaccgcggcttcatggtgtcggtcgggttcatagccattgagattcaacctgtgcatcattttgtccgaatttagcgataatttgtcattttagcttgattcaacataacaataaaaacggtaaggtacagcctcgtttgtaacaatgagaagcatatgacctgttcaacttcattaagcggcaaaaacaggattgtccttatcgctggcattttaatgattgccacaacattacgcgtcacctttaccggcgcagcaccgttactggatacgattcgttccgcttactcgctgacgacggcgcaaaccggcttattgaccaccctgccattattagcctttgcgctaatctcacctctggctgccccggtggcgcgacgttttggtatggaacgtagcctgtttgccgcgttacttttgatctgtgctggtatcgcaattcgctctctcccttcgccttacttattatttggcggtacagcggtcattggcggtggaattgcattaggcaatgtcttactgccaggattaattaaacgcgatttccctcattccgtcgccagacttaccggcgcatattccctgacaatgggagctgcagcggcactgggatcggctatggtcgtgccgctggctttgaacggttttggctggcaaggcgcgttgctcatgctgatgtcttttcctctgctggctctttttttatggctgccacagtggcgaagtcaacaacatgcaaatttgagtacctcacgcgccttacatactcggggtatctggcgttctccgcttgcctggcaggtaacattgtttcttgggatcaactcactggtctattacgtgattattggctggcttccggcgatcctcatcagtcacggctatagcgaagcacaggcgggttcactgcatggtttgctgcaactagccacagcagctcccggtttgctgatcccacttttcttacatcatgtgaaagatcagcgtggtattgcagcgttcgttgccttgatgtgcgcagtgggcgcggttgggctctgctttatgccagcgcacgcgatcacctggactctgcttttcggttttggttccggcgcaacaatgatactggggttgacgttcattggtcttcgggcaagttctgcgcatcaggcggcggcactctcggggatggcacaatccgtcgggtatttgctggcagcctgtgggccgccgctgatgggtaaaatacacgatactaacggtgactggtccataccattgatgggtgttgccatactttcactactgatggcgattttcggactttgcgccgggagagacaaagaaattcgctaatatccggtgctatagtgacgtgaccaatcatgcgtggaagggagaacaaacacgatgaatattcagtgcaaacgcgtttatgatccggcagaacagagcgatggttatcgcgtactggtcgaccgcctctggccgcgtggtatcaaaaaaaccgatttagcccttgatgagtgggataaagaaatcacgccgtcaacggaactgcgcaaagcctttcacggcgaagtcgtcgattttgcaacctttcgcgagcaatatcttgcagaactggcgcaacatgagcaagaaggaaagcggctggcggacatcgccaaaaaacagccgctgaccctgctctactcagcaaaaaacaccacgcagaaccatgcgctggtgctggccgactggctacgtagcttgtgattttagtacagcatccggcggttatttttcaccagccggatggtcccgtcgccacaatgcccattcatcaatcgtttcaccgcccggtaatttgcaattgttgctgaccccttgcgttgtctgcactggaatgagcgtcccgcccttctgctggcaatagaccgacgccggatttgccataccaatctgcggcggtttgggtgcttctggctgagaaggggttgaacaaccagccaggaccagcaagcaaggcagaacaaaactgataattttcatttattgatctcacatatttatccagacttagagtatcgcggtatcgttttgttttgcagcactatttttattacattcactcaaatcatattacgccttgtttcatctttgttgatgatgttttatcatgcctgcaaagattaaataatcagcatttacccgccgtatcctggagttgtttcgtgtcagatcagattatcgcccgcgtctcacaatcccttgccaaagaacagtcactggaaagtctggtccgacagcttctggagatgctggaaatggtcactgatatggaatcaacctacctgaccaaagtggatgtcgaagcgcgcctgcagcatattatgtttgcccgtaacagccagaaaatgcacatcccggagaattttaccgtctcgtgggattactcgttatgcaaacgcgccattgatgaaaactgctttttcagcgatgaagtccctgaccgttggggcgactgtattgcggcacgcaatcttggcatcaccacatttctgagcacgccaattcacttaccggatggatcattctatggcacgctttgcgccgccagtagtgagaagcgccagtggagtgaacgcgcggaacaggttttacagttattcgccggactgattgcacaatatattcaaaaagaggcactggttgaacagctgcgcgaagccaatgctgcgctgattgcgcaatcgtataccgactcgttaaccgggctaccgaatcggcgggcgatttttgaaaacctgacgacgctgttttctctcgcccgacatcttaaccataagataatgatcgcgtttatcgatctggataacttcaaattaatcaacgatcgttttggtcataatagtggtgatttgttcctcattcaggttggcgagcgccttaatacgctccagcaaaatggcgaagttattggtcgtctcggcggtgatgagtttttggttgtttcactgaacaacgagaatgcggatatttcgtctctgcgagaacgtattcagcagcaaatacgcggagaatatcacttaggtgatgttgatttgtattatcccggtgccagtcttggcatagtagaagtcgatcctgaaacgaccgatgcagacagtgccctgcatgctgccgatatcgcgatgtatcaggagaaaaaacacaaacagaaaacaccttttgtcgcgcatccagcgctacattcctgaggcgtattcacatccttttgattggtgataacatgcgaatcggtattatttttccggttgtaatctttattacagcggtcgtatttttagcatggttttttattggcggctatgctgccccgggagcataaagatgaaaaaaacaacgattattatgatgggtgtggcgattattgtcgtactcggcactgagctgggatggtggtaacgtcacatctagaaaatagcaaaggctgcctgtgtgcagcctttgtgcaatttacgcgttaacttttaatctttctgtagataaacagcacgacaatcgcgccaataacggcaaccacgaagctgccaaaattgaagccatcgactttaccaaagccaaacagcgtgctgatccatccgccgactacggcaccgactatccccagcaggatagtcataaagaatccaccaccatctttacctggcatgatccacttcgccagaataccggcaataagcccaaaaataatccatgacagaatgcccattgtttcctcacttatctgttttgcattagcgggttagtcgctgataaaaagcatagcacaacatcgggagggcaagatttgtgacgagcatcacggaggatttttttgcgatggcgcagaaattgcgccatcaacgatcagtgataattaccaaccacaaacatcatgttcgttttccgtgtcataagaacgcacggtattcaccagatcttttatcacttcagccgccacttctggcaccagcaaagtcatcggcgtctctgtttcataatcgacagaaacgccattgctgttattggtgacggtcacggtatacgttgctttgcccatgattcatttcccgttatgaatgacttttcgttgttgcgcgccttccatcaggacttcaggggcaacgaagaagtcaatgttgaaataagtatcgtcagtcatggcttcaatgttgtgccacttttctggagggaacaccgcaaactgccccgcttcgataaggattacttgatcaggctctgtactgtgttcatcagcgtagccgagatatttgaccgccccatgcataacggaaaggcgtgggtaaacccccgggcgcgttcctttatcaagatgacgttcgaatattccggcaggcgcagtttgtttattccagaaaggcgttgagcgcgtatgaatataattctgtgggatttgcagcatccttttccctccttcggtgaatgcgctgaaaacggtttattccagccgtttcagggtacgcctgataatttgcattttaaataccatttattggttactttttagcaccgtatcagagaagaatcagggaggattacaggtgggaagcccgcgacaacgcgggctgaatgcatcaggactggagcgtcgccagtcgggcggcgaaacccacaaacatcaaaccaatcagtgagttgcccactttagccagtttctttttggtacgtatatactgcgtgacaaaagcaccagaaataatcaggaagctcaaatagcagaaactcaccagttccagcgtcgtcgccagaataaagaatgaaattcccgtatgtggggcattaacatcgataaactgtacgaaaaacgacacatagaacaaaatggctttcggattagtcaggctcaaaattaacgcgcgtttaaaaatggcaccgtattggggctcatcggatttggcctcgttatttttacccttcagggtcgcgtagagaattttactccccagatagagcaaataaaatgcaccaagataacgtacaatgttgaataatatcggggtggtcttaattaatgtcgccactccagcccatgccagaaacatcaataccgcatcgccaataaatacaccgcaggccgcaagataaccgcctttcataccgctactgacgctatttttgagtacaaacagggtatttggccctggcaccaacacaataaaaatggccccaaccagataggtccagtaattcagaaccccgtattcagcgaacacattaacctctttaattatctttcgatcatgcgcgattaaaggtgaatatgctaaccaatctgtagcggcttagaaaggagaaaatcaggttttaacccgatatcaacccgataattgaatcattaatcaggcatgctccagtgaaaaattcgggtagtgctcggcaaaatactggcgtaaaaattctaccgttatccgcactttcgctgacgtcgccagccttgaaacataaacggcccagacgttcgctggctggtaatattccggtagcacttgtactaaatgaccactggcaatgttttcgctaacatcccaccaggagcgcagagcaatcccctgcccatcgagacaccactgatggacaatttctccatgattagacgacagtgggccggtaactttaatcgcatggtggccttctttattgcgtaattgccagacaccaaaaggatgatcgcgctctttaatgaccaggcacggcaatgcagaaagatcggttaaatgtttcggcgcgccatgttgcgcaataaattccggcgacgcgcagagaatgcggtaattggtcgccagtttgcgggcgattaaattaggggcgatatcatcgccaatgcgaatatcgagatcgacaccttcattgaccaaatcgaccaaccggtcttccacatcaaaacgtaattccagttgcggatacgccttcgccagcgctgataacgccggagccactacctgtcgtccaaaaccaaagctgctgataatacgcagcatcccctgcggcacctgacgcacgtcagaaagttcgtccatcatttgaccgacatcctgcaaaatccgctgcgcccattcataaatccgctctccttcttcggtaatggtgacgcggcgggtggtgcggtgtaacaacaccacgtttagcgtttgctccagcaaggcgatgcgcttgctgacgaacgccggagaaacgcccagttcttccgccacggcggcaaaaccagcccggcgagccaccagcataaagacgcgcaaatcgttcagcagcggtaaattattcatgattcgtgttttatgtttcaccagttacggggattaattccttttcagtcaattataggatgagggtattgtcaattttgatggtcaggaagtgagaacccaatgatgaaaacgatgcgtattgctgcgatcccgggagacgggattggcagagaagtccttcctgaagggattcgcgtgttacaggctgccgctgagcgctggggcttcgccttgagttttgagcaaatggagtgggcgagctgcgagtattacagccatcacggtaaaatgatgccggacgactggggtaatgactccaacttactgatagtgttttatgttcagataatgcccgatgaccttgtcatgcagctccaccgattttgagaacgacagtgacttccgtcccagccttgccagatgttgtctcagattcaggttatgccgctcaattcgctgagtgtaacgcttgctgattacgtgcagctttcccttcaggcgggattcatacagcggccagctgatggtgataccacgagctttttcttccggcgcgttatcgatctggtcgaatgcacgagcagcaccgccgtaggttttagccagtacggtggtgattgcagcggtcagagtagttttaccgtggtcaacgtggccgatagtaccaacgttaacgtgcggttttgtacgttcaaatttttctttagacacggctatattccttactatagtgctctccccttcaggagagagcacgggactttggtattaacccttaggcttatttaccacgggcttcaattacggcctgagcaacgttactcggcgcttcatcatacttcaggaattccatggtgtatgatgcacgacctttggtcagagaacgcagctgagttgcatatccgaacatttcagacagcggtacttcagcgtggatcttaacgccagtaacttcagattcctgacctttgagcataccacgacgacggctcaagtcaccgataacgtcaccggtgttctcttccggagtttctacttcaaccttcatgatcggctcaagcagaactggtttcgctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataacaacatgaccatactgaccacgaccaccagactgtttcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgcccatacccgcgatgatggtctggttagattcttcgtcagtccatacacggaaagacgggtcttctttagccagacggcccagagccagacccattttttcctggtcagctttggttttcggttcaactgcgatggagattaccggctcagggaattccatacgttccagaatgatcggcgcatccgggtcacacagggtgtcaccagtggttacgtctttcagaccgatagcagcagcgatgtcgcccgcgcgaacttctttgatctcttcacgtttgttagcgtgcatctgaacgatacgaccgaaacgctcacgtgcagctttcacggagttcagtacggtatcaccagagttaaccacaccggagtaaacacggaagaaggtcaggttaccaacaaacgggtcggtagcgattttgaacgccagtgcagagaacggctcgtcatcacttgcgtgacgttcagccggagtgtctttaccgtcgtccaggataccgttgatcgcaggtacgtcaaccggggatggcaggtaatcgattaccgcatccagcatcgcctgaacacctttgttcttgaacgcagaaccacaggttaccaggatgatttcgttgttcagaacgcgctgacgcagagcacctttaatctcttcttcagtcagttcttcaccacccaggtatttttccatcagctcttcagaagcttcagctgcggattcgatcaggttctggtgccattcgttagccagttcaaccatgtctgccgggatatcttcgtattcgaaggttacgccctggtcagcgtcgttccagttgatagctttcattttcaccaggtcaacaacaccggtgaaatgttcttcagcaccaatcgccagctgcagcggaaccgggttcgcgcccagacgggttttgatctggttaacaactttcaggaagttcgcacccatgcggtccattttgttaacgaacgcaatgcgcggaactttatatttgtttgcctgacgccatacggtttcagactgcggctgaacaccaccaactgcgcagtaaaccattaccgcaccatcgagaacacgcatggaacgttctacttcgattgtgaagtcaacgtgccccggggtgtcgatgatgttgatgcgatgcggctcatactgcttagccataccagaccagaatgcagtagtcgcagcggaagtgatggtaataccacgttcctgctcctgctccatccagtccatggttgcagcgccgtcatgaacttcaccgattttatggtttacaccggtgtagaacagaatacgttcggtagtagtggttttaccggcgtcgatgtgcgcactgataccgatgttacggtagcgtgcgatgggtgttgtacgagccatttgtttcctcgtttatcttttaggcgttcaatttaagtagcccaaagcgggctgcttactggaagcgcccgcctggtgactaaaactccgaagggattaccaacggtagtgtgcgaacgccttgttggcttcggccatacggtgaacgtcttcacgtttcttaactgcagtacctttgttttctgcagcatcagaaagttcgttcgccaggcgcagagccatggatttatcaccgcgtttacgagcagcttcaacgatccaacgcattgccagagcattacgacgaaccggacggacttcaactggtacctgataagtagaaccaccaacgcggcgagacttaacttctacagtcgggcgcacgttttcgagagctacttcgaatgcttccagttcagatttaccagagcgctgagccagggtctccagcgcgctgtatacgatagattcggcagtagattttttaccatctaccatcaggatatttacaaatttagccagcagttctgatccgaacttcggatccggcagaattttacgctgaccaatgacgcgacgacgtggcatggaaatactccgttgttaattcaggattgtccaaaactctacgagtttagtttgacatttaagttaaaacgtttggccttacttaacggagaaccattaagccttaggacgcttcacgccatacttggaacgagcctgcttacggtctttaacgccggagcagtcaagcgcaccacgtacggtgtggtaacgaacacccgggaggtctttaacacgaccgccacggatcaggatcacggagtgctcctgcaggttgtgaccttcaccaccgatgtaggaagtcacttcgaaaccgttagtcagacgaacacggcatactttacgcagcgcggagttcggttttttaggagtggtagtatatacacgagtacatacgccacgtttttgcgggcatgcttccagcgcaggcacgttgcttttcgcaactttgcgagcacgtggtttgcgtaccagctggttaactgttgccattaaatagctcctggttttagcttttgcttcgtaaacacgtaataaaacgtcctcacacaatatgaggacgccgaattttagggcgatgccgaaaaggtgtcaagaaatatacaacgatcccgccatcaccaggccatctggctggagtgcttaaccgtaagtctgacgaaatcagtatagtcaatgggaatgatgtcgttcgaaatttgaccagtcaaaccgcgggcaataaggtcttcgttcagggcatagaccttaatgggggcattacgcagactttcaaggtagcggttaccgtcaactgcggcagttacaccatcttgcaataatagcagttcgtcgccttcactgagtagacgcaacagcgcagcaaaatccgtcagccagggtgaacgatgtaatgtgtgcagcataaacgcctcaaaacctcaaaataacatcgtagttggcgagttcgcggcgtaaggcatctgcttcgagcggcgtggcttcgacaacaaagggtgtctgcggatctaacccgcgttcgcgcagtgaagccgcacaaacccagcactgttcaatgtcgtacagacccaacaatttaaaagtggcaatgtaatcacgcgccagcactgcatcgggcttttgtccttgcagcagctgaaaaacgccatcagcaataaagaagacggccagatcgtcagttaatgcggaagttgccagtaaagcatctaaaccttcccgaccagcagctgtaccatgaggtgcagtagaaaaaacaaacgcaattcgtttcatcagaactgtaccaccctgtcacaggtcagcgaggcttccgccagcgcgccaagtccgcttaaggtaaatcccgactgaagatttgacgaagccagccccagccttcctgcttcagtttcatcgacgataccgcggcgtaacgctgccgctacgcagatattcagcgccacaccatgttgcgcattcaattgttgccagccgcgcacaaggtcaaattcatcgcttgccggtgaggtcaattggttagcgttatagaccccttcccgataaaaaaagacgctgcttaactcatggccttctgcaatcagcgcctgcgcaaactgaaaagcactactcgcctgttgcgtaccgtatgctggcccggtcaccacgatggcaaaacgcattacttatcttgcccctggaaatcaccgctcttgaactggcggatgtagagatagacagtgtgtttggagatgttcaggcggtcagcaacctggttgatcgcgtctttaatatcgaagatccctttctcgtagagattcagcacgatctgacgatttttggcgttattagaaacattgcgatcggcattcacttcttcgatggtgaactccagcgtttgggtaaccagatcttcaacagaagaggcaaagttgacgcttgaaccgacatccggggtttctggcggcacaaaagtgctcataatctgcgagaagggaacatcaagattcatattgatgcacagcagaccaattacacgctgttcgcggttacgaatcgcgatagtcagggacttcattaatacgccgcttttggcgcgagtaaagtagcatttagaaacgctgctatccgctcccgtcatatcgtgcagcatacgtagcgccaggtcggtaattggcgaaccaatcttccggcctgtatgttcaccgttagcaatgcgaatggctgaacattttagatcctgcaaagagtgcaaaacgatttcacagtgggagccaataagcatcgctaacccgtccaccaccgcttcgtaggatttcagaatatcaaaatcggtctggtcgaaaggacgttgatccagtaaatccaactcactggtttcgttggttaaaagcgacctggacatgaaaaaaaacactccttttcaggagcctgtcgttaacttttcagggcaggctcattaatgatgcgggtaactaaattaatacagcggaggttccgctttccagcactaattatatccggcctgtaataaaaaaaccgccgcctggtcaggcggcggttcttaatgcttattttttagcagaatctgcggctttcgcatcagcttccggctttgcatcagccttcggcgctggtttcacatccagcagctctacgtcaaacaccagggtagaattcggtgggatccccggaacacccgctttgccgtaagccagttctggtggaataaccagtttgatcttaccgcctttcttgatgttcttcagaccttctgtccaacccggaataacaccgtccagacggaaagagagcggttcaccacgggtgtaagagttgtcgaactctttaccgtcgatcagcgtacctttgtagttcacgacaacagtatcgctgtctttcggtgcttcgcctttaccggcttcgactacctgataaaccagaccagttgaagaggttttcacacctttctctttggcaaatttctcgcggtactctttaccttttgcttcgttatcagccgcgtctttttccatcttcgcctgagcagaagacttcacgcgagcttcgaatgcttgcagtgtctgttcgatctcttggtcagagagtttgctcttatcagcaaatgcatcctgaacaccagcgatcagctgatctttatccagtttgatgcccagtttttcttgttctttaagagagttttccatgtaacgacccagcgaagcacccagtgcataagctgatttctgatcgtcatttttgaacgctgctttgctgtcagcagttgtagcaggttttgcagcttcagcagcaaaagtgatcggtgcatgcagggcaacggccattgtggtcgccagcagcgttactttaaacagtgatttcatccatatctccaggatcggggcatctcaccccagggttaactattatcagaagggtactataaagcgttgtcgaacaaatctacatacagacacgccctattatcatctattttcagactctttttgtttaaattagtttcgatgaccgcgaaatgagtgctgtctcgggcagcaaagttaagtagaatccgcggcgaccattcgacaaaagaggtgaatcatgcaggatttatcatttgaagcacgcctggcagagctggagagccgactggcttttcaggaaatcaccattgaagaactgaacgtcacggtgaccgctcatgaaatggagatggcgaaactgcgcgatcatctgcgtctgctgaccgagaagctaaaagccagccagccgtcgaacatcgcgtcgcaggctgaagaaacgccaccgccacattattgaggcgtaaaaaaagcggggattccccgcttttttgtcactttttcggtattagtggcaaccgcaaccgccgttacctttaccgccgcagcagccttcgccaccgtgttcatgaccgtgatcgtggccatgaccaccgcagcaaccgtcgtggtcgtgatcgtggtgatgatcgtgcgcaccgtgaacgtggccatgagccagttcttcttcagtcgcttcgcgaatcgccacaacttcaacgttgaatttcaggttctgaccggccagcatgtggttaccatcaaccacgacgtgatcgtcttcaaccgcagtgatttcaaccggtaccggaccctggtcagtttcagccaggaaacgcatacctacctgcagttcatcaacgcccataaatacgtctttaggaacgcgttgcaccaggttttcgtcgtactgaccgtaagcgtcgttcgcgccaacagcgacatcaaatttgtcgccaacttcgtgaccttccagcgccgtttccaggccagagatcagggaaccgtgaccatgcaggtagtccagcggcgcactcaccggagactcatcaaccaacacaccgtcttctgtacgtacctgataggccaggctgaccaccaggtcttttgctactttcatgatatctcctgagcatgggaagaatagtggcgcagattgtagcggaattctgcagccgtgtactcactagcttaaaaaaactcggcgcatatcgctagtccggatgaaaaatcccgatcacttgctcatctttgcgaacgtgatcgcgggcttctttgtctgcttctcgcatctgatgtccgcacttaacacattcaacaatatcaatattattttcgcgccacatcgccattgaatcctgcgcctgacaggccgggcattttgcgctcgcaataaaacgttttcggattgccatctttaccctctactcaaattcatcccagccgtccagctggcgtcgttcttgttgcatttcacgctggaaaatctcttccagttcgcgtcgggcttccctggcgcgagaaatttgtacggtatcggcatgcattgggatgagctctcgcaacatccgcatatccaggcgacgaaaatgcagctgcgcccgctgtgcctgatgcggatgcatgccaagcgtgaccagcgtcttgcgtcccagctctaacgcactggagaatgtctcacgagaaaactgcgtcacccctgcctgtaataactcatgcgcctccacacgtccgcgcgctcgcgcaagaatatgtaaatgcggaaagtgctgctggcatatttccaccagtttcatggtgtcttccggctcgttacaggtaatgacgatagactcagcggcctctgcacccgcagaacgtaacagatcgacctgcgtggcgtcgccgtaataaactttgtagccatatttacgcatcaggttaacggcactgatatcccgctccagcacggtaatgcgcattttatttgccatcagcaagcgaccaatcacctgaccaaaacgcccaaagcccacgacaatgacctggggtttatcatcgttgacccacggtttttcgtcttcttcttccggtccgttaaactggcgggatagccatttatccaccagcttcatcagcaacggtgtggtcatcatggaaagcgtcaccgtcaccagcaacagcgccatctggtcgccctggaataagcgttgcgaagaagcggtagaaaagaggacaaaggcaaactcgccgccctgactcaacacgccagcaaactgcatccgctctgagctacgcacgccatacaatcgcgccagcagatacagcacgagaattttcaccgccaccagcacaaccacagctatcactacccacaacagatgggtataaagcaccccgaggttgagtgacatgccgacagagataaagaacaaaccgagcagcaagcctttgaagggatcgatagccgtttccagttcatggcgatattcactttccgccagcagcacgcccgcaataaacgtaccgagcgccatcgacagccccagcgcatccataaataacgcggaacccaacaccagcagcagagtcgcggcggtgaacacttcccgcacgccagaagctgcaataaaacggaataccggacgcagtaaataacgcccgccaatcagcatgccgacaaacgccagcaccttcatgccgatcttcatccagtcgaaatgttcgtctgccgaccccgccaacaacggcactaacgccagtgccgggatcaccgccagatcctgaaacagcagtaccgagaaacctaactggccggattcgctgcgattcatccctttatcacgcatcagttgcaacgccattgcagttgaagacatcgcaaggccaatgccaccgaccaccgccgcctgccaggcgaaatccgtcagcatcaataatcccgccagcaacgccgcgcttaacagcacctgtgccgcacctacgccaaaaatcgaacgccgcaattgccaaagcttggagggattcaactccaggccgatgataaacatcaggaacaccacgccgagttccgaaaagtggaggatctcatcgacgtcgctaataaaacccagcccccacgggccaattgcaatccctgccagcaaatatcccaacacagcgccaatacccagccgcgatgccagcggcaccgcagccaccgccgcgaagagaaacaacactcctgcgagtaaaaaatcggaaccttccatcagcggcctcctggagacagcggatttgccagccagtcaccgtaggctctggcgtgactcgccagctcctgtgcgctttgccgtctcgcccagtaaataatgatgggactcaaccaatgcatccggcacatgcccgccgccagttcaaaggggcgcagaacatcgctcatcgggtagcgattcaaggcgtcataacggtaagcactttccggctcgccggtggtaatcacgctacgccagtactttcccgccagttggtttcctcccggcccgctggcaaaaccacggcttaatacccggtccagccactctttcagtagcgccgggcagctataggtataaagaggatgctgaaagacaatcacctcgtgctcgcgcagtaatgcctgctcacgggggatatcaataaaaaaatcgggatagtgcgcgtaaaggtcgtgcacggtaacattgctgagctgcgtggccggtttaagcagtacccggtttgccaccgagtcctgagattccggatgggcatacagcagcaaaactttcgctggctgagacatcatccccctcccggtatggtttttgtgtatagtcgctgttttgggctaccattgcgcccggtgcggcagctcgcccatacattacattatcataatgataagttaacatagtctgaacatacggcaccttatgattgttttctcctcgttacaaattcgtcgcggcgtgcgcgtcctgctggataatgccaccgccaccatcaaccccgggcagaaagtcggcctggtgggtaaaaacggctgtggtaaatctaccctgctggcattgctgaaaaatgaactcagcgccgacggcggcagctacacctttccgggaagctggcaactggcgtgggtgaatcaggaaacgccggcgttaccgcaagcagcgctggaatatgtcattgacggcgaccgtgaatatcgccaactggaagcgcagctacgcgacgccaacgaacgtaacgacgggcacgccattgcgaccattcatggcaagctggatgctattgacgcatggagtattcgctcccgcgccgcaagtctgttgcacggcctcggtttcagcaatgaacaactcgagcgtccggtaagtgatttctccggtggctggcgtatgcgtcttaaccttgcccaggcgctgatttgccgttcagacttgctgctgctcgacgaaccgactaaccacctcgatctcgatgccgttatctggctggaaaaatggctgaagagctatcagggcacgctgatcctgatctctcacgaccgcgatttcctcgatccgatcgtcgataaaattattcatatcgaacaacaaagcatgttcgagtacaccggcaactacagttcgtttgaagttcagcgcgccacccgtctggcgcagcaacaagcgatgtacgaaagccagcaggaacgcgtggcgcatctgcaaagttatatcgaccgtttccgtgccaaagccaccaaagcgaagcaggcccagagccgcattaagatgcttgagcgtatggagctgattgcccccgcgcacgtcgacaacccgttccgctttagcttccgcgcgccggaaagcctgccaaatccgttactgaagatggaaaaggtcagcgcaggctatggtgatcgcattattctcgactcgattaaactgaatctggtccccggctcgcgcattggtctgctaggccgcaacggcgcgggtaaatcgacattaatcaaactgttagccggtgaacttgcgccagtcagcggtgaaattggtctggcgaaagggatcaagctcggctacttcgcccagcatcaacttgaatacctgcgcgccgacgaatcgcctattcaacatctggcacgtttagcgccgcaggaactggagcaaaaactgcgtgactacctcggcggctttggtttccagggcgataaagtgacggaagaaacgcgccgcttctccggtggggaaaaagcccgcctggtgctggcattaattgtctggcagcgtccgaatctgctgctgctcgacgaaccgactaaccaccttgacctcgacatgcgtcaggcactgactgaagcattaatcgagttcgaaggcgcgctggttgtcgtctcgcacgaccgtcatttgctgcgttccaccactgacgatctctacctggttcacgatcgtaaagtcgaaccgttcgacggcgatctggaagattatcaacagtggttgagcgacgtacaaaagcaggaaaaccagaccgacgaagcgccaaaagagaacgcaaacagcgcccaggcacgtaaagatcagaagcgtcgggaagcggagctgcgtgcgcaaacccaaccgctgcgtaaagagatcgcccgtctggaaaaagagatggaaaagctgaacgcacagctggcgcaggcggaagagaaactcggcgacagcgaactgtacgatcaaagccgtaaagcggagttgaccgcctgcctgcaacagcaagccagcgccaaatccggcctggaagagtgcgaaatggcgtggctggaagcccaggagcagcttgagcagatgctgctggaaggccaaagcaactgatggcgcagataacgacgaccgatgccaatgaattcagcagcagtgctgaattcacccccatgcgcggctttagcaattgtcatctacaaaccatgctgccgcgtctgtttcgtcgtcaggtgaaattcaccccacactggcagcgactggagttgcccgacggcgattttgtcgatctcgcgtggagtgaagaccccgcacaggcgaaacataaaccgcgtttagtggtgtttcacgggctggaaggcagtctcaatagcccttacgcccacggtctggttgaggcggcacaaaagcgcggctggctgggcgtggtgatgcattttcgcggatgcagcggtgaaccaaaccgtatgcaccgcatttaccattcgggcgaaaccgaagacgccagctggtttttacgctggctgcaacgcgaatttggtcatgcgccaacggctgccgtcggctattcgctcggcggtaatatgctggcctgtttgctggcaaaagaaggtaataacctcccgattgatgccgcggtaattgtctccgcgccatttatgctggaggcctgtagttaccatatggaaaagggcttttcccgcgtttatcagcgttacttgctgaacctgttaaaagccaatgccgcgcgcaagctggcagcctaccccggaacactgccgattaatctcgcgcagttaaaatcggtacgtcgcatccgtgaatttgacgatctcatcaccgccagaattcacggctacgctgacgctatcgactattatcgtcagtgtagcgccatgccgatgctcaatcggatagccaaaccgacgctgattattcacgccaaagacgatccgtttatggatcatcaggtgatcccgaaaccggaaagtctccccccgcaggtggagtatcagctgactgaacatggcggtcatgttggctttattggcggtacattacttcatccgcaaatgtggctggagtcacgtattcctgactggttaacaacgtatctggaggcgaaatcatgttgattccgtggcaagacctctcccccgaaacgctggaaaatttaattgaaagctttgtgttacgtgaaggcaccgattatggtgaacatgagcgtacacttgaacagaaagtcgccgacgtcaaacgccagctacagtgcggagaagcggtgctggtatggtcggagctgcacgaaacggtcaatatcatgccgcgcagtcagtttcgcgaataacctgcaaccgtcggcggacgagataataatgatagctaagtcatggagttactatgtctgccaaacatccggtcattgcggtaacaggatccagcggcgcggggaccaccaccaccagcctcgcgtttcgtaaaatattcgcgcagttaaatctgcatgcagctgaggtggaaggcgacagttttcaccgttacacccgcccggaaatggacatggcgatccgcaaagcgcgcgacgccgggcggcatatcagctacttcggccccgaagcgaacgactttggcctgctggaacaaaccttcattgaatatggtcagagcggcaaagggaaatctcgcaaatatctgcatacctacgacgaagccgtaccgtggaatcaggtaccggggacattcaccccatggcaacctttaccggaacccactgatgtactgttttatgaaggtttacacggcggcgtcgtcacgccacagcataacgttgcgcagcatgtggacttactggtcggcgtggtgcctatcgttaaccttgagtggattcaaaaactgatccgcgacaccagcgagcgcgggcactcacgagaagccgtgatggactcggtagtgcgctcaatggaagactatatcaactacatcacaccgcagttttcccgcacccatcttaacttccagcgcgttcccaccgtcgacacttcaaacccgttcgcggcaaaaggtatcccgtcgctggatgaaagctttgtggtgatccattttcgtaatctggaagggatcgatttcccctggctgctggcgatgttgcagggctcattcatttcccacatcaatactttagtggtgcctggcggcaaaatgggtctggcaatggaattaattatgctgccgctggtgcaacgattgatggaaggaaagaaaatcgagtaactttgctattacgccggataaaatactatccggcttcacaatgggatagttaaatcacgcggcaaccacttcatacgagtgagtaatattcaccgctttttccagcatcaacgctactgaacaatatttctcggcagagagatctaccgcacgcgcaaccgctgcgtctttcaggtcgcgaccggtgacgataaaatgcagattaatgtgcgtaaacaggcgtggtgcctcttcgcggcgttcagaggtcaattttacttcacaatcgaccacatcctgacgccctttttgcagaatagaaaccacatcgatggcactgcaaccccccgccgccatcaacaccatttccatcggacttggtgctttatcgcctgagttgccgtccattaaaatctggtgaccagaggcggattcgcccagaaaagttaacccttcgacccacttcactcgcgcttgcatttttgctactccactgcgtcaattttcctgacagagtacgcgtactaaccaaatcgcgcaacggaaggcgacctgggtcatgctgaagcgagacaccaggagacacaaagcgaaagctatgctaaaacagtcaggatgctacagtaatacattgatgtactgcatgtatgcaaaggacgtcacattaccgtgcagtacagttgatagccccttcccaggtagcgggaagcatatttcggcaatccagagacagcggcgttatctggctctggagaaagcttataacagaggataaccgcgcatggtgcttggcaaaccgcaaacagacccgactctcgaatggttcttgtctcattgccacattcataagtacccatccaagagcacgcttattcaccagggtgaaaaagcggaaacgctgtactacatcgttaaaggctctgtggcagtgctgatcaaagacgaggagggtaaagaaatgatcctctcctatctgaatcagggtgattttattggcgaactgggcctgtttgaagagggccaggaacgtagcgcatgggtacgtgcgaaaaccgcctgtgaagtggctgaaatttcgtacaaaaaatttcgccaattgattcaggtaaacccggacattctgatgcgtctgtctgcacagatggcgcgtcgtctgcaagtcacttcagagaaagtgggcaacctggcgttcctcgacgtgacgggccgcattgcacagactctgctgaatctggcaaaacaaccagatgctatgactcacccggacggtatgcaaatcaaaattacccgtcaggaaatcggtcagattgtcggctgttctcgtgaaactgtgggacgcattctgaagatgctggaagatcagaacctgatctccgcacacggtaaaaccatcgtcgtttacggcactcgttaatcccgtcggagtggcgcgttacctggtagcgcgccattttgtttcccccgatgtggcgcagactgatttatcaccccgatatcaactatgcactgcgacaaacgctggtgctatgtttgcccgtggccgttgggttaatgcttggcgaattacgattcggtctgctcttctccctcgttcctgcctgttgcaatattgcgggccttgatacgcctcataaacgttttttcaaacgcttaatcattggtgcgtcgctgtttgccacctgtagcttgctgacacagctactactggcaaaagatgttcccctgccctttttgctgaccggattaacgctggtacttggcgtcactgctgagctggggccattgcacgcaaaattgcttcccgcatcgctgctcgccgccatttttaccctcagtctggcgggatacatgccggtctgggaaccgttgctcatctatgcgttgggcactctctggtacggattgtttaactggttttggttctggatctggcgcgaacaaccgctgcgcgagtcactaagtctgctgtaccgtgaactggcagattattgtgaagccaaatacagcctgcttacccagcacaccgaccctgaaaaagcgctgccgccgctgctggtgcgccagcaaaaagcggtcgatttaattacccagtgctatcagcaaatgcatatgctttccgcgcaaaataataacgattacaagcggatgctgcgtattttccaggaggcgctggatttgcaggaacatatttcggtcagtttgcatcagccggaagaggtgcaaaaactggtcgagcgtagccatgcggaggaagttatccgctggaatgcgcaaaccgtcgccgctcgcctgcgcgtgctggctgatgacattctttaccatcgcctgccgacgcgttttacgatggaaaagcaaattggcgcactggaaaaaatcgcccgccagcatccggataatccggttgggcaattctgctattggcacttcagccgcattgcccgcgtgctgcgcacccaaaaaccgctctatgcgcgtgacttactggccgataaacagcggcgaatgccgttacttccggcgctgaaaagttatctgtcactaaagtctccggcgctacgcaatgccggacgactcagtgtgatgttaagcgttgccagcctgatgggcaccgcgctacatctgccgaagtcgtactggatcctgatgacggtattgctggtgacgcaaaatggctatggcgcaacccgtctgaggattgtgaatcgctccgtgggaaccgtggttgggttaatcattgcgggcgttgccctgcactttaaaattcccgaaggttacactctgaccttgatgctgattaccaccctcgccagctacctgatattgcgcaaaaactacggctgggcgacggtcggctttaccattaccgcagtgtataccctgcaactgttgtggctgaacggtgagcagtacatccttccgcgtcttatcgataccattattggttgtttaattgctttcggcggtactgtctggctgtggccgcagtggcagagcgggttattgcgtaagaacgcccatgacgctttagaagcctatcaggacgcgattcgcttgattctgagcgaggacccgcaacctacgccactggcctggcagcgaatgcgggtaaatcaggcgcataacactctgtataactcattgaatcaggcgatgcaggaaccggcgtttaacagccattatctggcagatatgaaactgtgggtaacgcacagccagtttattgttgagcatattaatgccatgaccacgctggcgcgggaacaccgggcattgccaccggaactggcacaagagtatttacagtcttgtgaaatcgccattcagcgttgtcagcagcggctggagtatgacgaaccgggtagttccggcgatgccaatatcatggatgcgccggagatgcagccgcacgaaggcgcggcaggtacgctggagcagcatttacagcgggttataggtcatctgaacaccatgcacaccatttcgtcgatggcatggcgtcagcgaccacatcatgggatttggctgagtcgcaagttgcgggattcgaaggcgtaatacaggctaaaccatcggataaggcattcacgccgcatccgacatcttttgcctgatgcgtcttatttacgccccaaccaccttcgccaccgcgtgggcgaaacgttgcatcccttcatcgatatccgcatcttccaccaccagcgacggtgcaaaacgcatcacatccggtccggcattcagcaccattacgccagcctctgcgcccgcatacaggaaatcacgcgtccgacctttgtactgtggtttcagctccgcgccaattaacagccccataccgcgaatatcgctaaacacatcgtactgctgatcgatcttctgcaaatggtcaacaaaacgctggcgtttcgcctgaatgccttccagcacttcaggggtattgatgatatcaaacgccgcgcccgctactgcacaggccagaggattaccgccgtaggtggaaccgtgagaaccaggatgaaatgcagaagcaatttccgccgtggtcagcatggcgctaatcgggaagccgccgcctaacgctttcgcagaggtcagaatatccggcgtcacgccgtagtgcatgtaagcaaacagatcgccggtccgccccatcccgcactgcacttcatcaaacaccaataatgcctgatgttgatcgcacagctcgcgcaagccctgcaaaaactctggcgtcgctgccgtcacgccgccctcgccctggatcggctcaaccaccaccgcacaggtgtgatcatccatcaccgctttcactgcgtggatatcgttaaaaggcacgtggatgatgtctgccggttttggcccaaagccgtcggaatattttggctgcccacccaccgaaacggtaaacagcgagcgaccatgaaaagcgttatggaaggcaataattttggttttgaacgggctatgacgcacacaggcgtaatggcgtgccagtttaaaggcggtttcgttagcttccgtgccggagttcataaacaccacgcgttcggcaaacgttgcctcaatcagtttacgaccaagacgcagcgccggttcattggtgaaaacgttactgatatgccacagagtttcgccctgggtttttaacgcgttcaccagcgcaggatggcaatggcccaacgccgtaactgcaatgccacccgcgaaatcgacatactccttgccttgctgatcccagattcggctcccctgaccttttaccggaataaactctgccggagcataaatcggcaggatcacttcatcgaaagtcgcgcgtgtaattgctgtttgttcagttgccatctcatgatcaccctgttacacataaataaatgtgaaattataatcacaaaatatgcataaaaaatcacttaatagcaatcagaaatcagcgatgcaggaaattagccagcagttgatgtccttgttcgctgagaatactttctggatggaactgcacgccttccagatcccactggcgatggcgaatccccataatctcgcgggtttcgctccaggccgtcacttcaaagcacgctggtaatgagtcaggttccaccaccagcgaatggtagcgtgtcacggtaagtggatttgccagcccccgaaatacgccctcaccgttatgtgtaatcggcgaggttttgccgtgcatgacctttgcggcgcgcacaactttgccgccaaatgcctgcgccattgcctgatgaccgaggcagacgccaagaatcggcaagcacccggcatagttgcgaataacgtcaagggagatcccggcttcatctggcgtacagggtccgggtgagatgacaattttttgtggtttaagggcatcgatatccgccagcgtcaacgcatcgttgcgcttaaccagcacatccgcccccagttcacaaaagtactggtagaggttccaggtaaaagaatcgtagttatcaataagcaggatcatggcggctccggtacgaaagaaccgcgctattttactcagattccccggcttcgcttaccactttgctaaatatcatctgcagcgcggtgagatcccccattgccccactctgatttgcctgattccaggcctctttttcgataccctgccagctcagttggtagcccgcatgaatcgccagctgctcgaagaagatccgctgtgccagtccgcttcccacacggaagggatgcagcacgttgatttcacaatagtaatgcgccagccgctcgacgaacttcgctttatccaggccaaccagataaccgtcttcctccagatcctgcatcagggcattgccctctttttcgatataagcaaagtggcagaacggcgtatcaccctgataaatatcaacttcacgcagttgccccgcccagtcgaaaatatcctgatacagctggcgatggatagtgcgcaaatgcggtaaaccgcgcaccagcggaccaagctcaatggtcgcagcacgtagcgccgtcatttcgtaagcggcctgttccagacgttgttgctggcggatgttcagccggttacgcatgatatcaaggccaggataaagatacggatcgcgcccttcgccgaatttatcgctcatagtgcctcctcagctcttcaagtcgcgctaaagcctctgcggcagtaagagtgactaaaggcatctcgacgccttcaagacggcgactggcctggaaattacgattacgctgaaactcccagagacgggacttttgcttatcggtgagtttcttcacttgatgcctccctgaacgtgtccatttgccacaagtataagcggcaaatccgggttacgccgggagagcagaagcgcgggcaagattgcccgcgcgagaaatcattacggcaggactttagcggaaaggataactaccggttttgacggcacattctggtacggaccaacatcatgagtcggcacctgggaaatcttatcggcaatgtccatgcctttcaccactttaccaaataccgcgtaaccgaaatcacgctgaccgtggtcaaggaaggcgttatcggcaacgttgataaagaactggctggtggcgctgtctttgtcagcggtacgcgccatcgcgatggtgccacgcgtgttgcgcaggccgttatcggcttcatttttgattggcgggtttggttttttctgctgcatctgctcggtgaaaccgccgccctgaatcataaagccaggaatgacgcggtgaaaggtagtgttgttataaaaaccgctgttcacataatcgacaaagttttgcacagacactggcgctttttgtttatccagttccagttcgatgttaccagctgaggttgtcaacaatacgtgcgggtcccctttcgctgccattgctgcgggagaaagagcagaaagagcgaaaacagcagccatcgccgccagggtcgatttgaacatgagatttccttaacaaacagagcagaaaaaaagcaagtgaagagattctaaatagccttcaagaacaaggccatccctttacctaattttacgtatctgaaatatatgtaacctgacgatcactttttattctgtgataaaaatcacctcttaaaatgcaatttagcaaccgattgcaataaaacatttaatcagatcacaaaatcacctaaaatcgcccgctcgcggcatagcccgctatgccattttatttttgaacgcaggccaatcatgactaacagcaatcgcatcaagctcacatggattagctttctctcctacgcactgaccggtgcgttggttattgtcaccgggatggtgatgggaaatatcgccgattatttcaatctgcctgtttccagtatgagtaataccttcaccttcctcaacgccggcattttaatctctatcttcctcaacgcctggctgatggaaatcgtcccgttgaaaacgcagttacgttttggctttctcctgatggtgctggcggttgccggtttgatgttcagccacagcctggcgctgttctcggcggcgatgttcattctcggggtggtcagcggcatcaccatgtcgattggtacattcctgataacacaaatgtatgaagggcgtcagcgcggttcccgcctgttatttaccgactccttcttcagtatggctgggatgattttcccaatgatcgccgcgtttctactggcgcgcagcattgagtggtactgggtttatgcctgcatcgggctggtgtatgtcgctatttttattctgaccttcggctgtgagttcccggcactgggcaaacatgcaccaaaaacggatgctccggtagagaaagaaaagtgggggatcggcgtgctgtttctctccattgcggcactgtgctacatcctcggtcagttaggttttatctcctgggtgcctgagtatgccaaaggcctgggcatgagcctgaatgatgctggtacgctggtgagtaacttctggatgtcatacatggtcggcatgtgggcgttcagctttattcttcgcttctttgatttgcaacgtatcctgaccgtactggcgggtctggccgcgattctgatgtacgtctttaacaccggaacaccggcacatatggcgtggtcaattctcgccctgggcttcttctccagcgcgatctataccaccatcatcaccctgggttcacagcagaccaaagtaccgtcgccaaaactggttaactttgtcctgacctgcgggaccatcggtactatgttgacctttgtggttaccgggccgattgttgaacatagcggtccgcaggcggcactgcttacagcaaacggtctgtacgctgtcgtctttgtgatgtgcttcctgttaggtttcgtcagccgtcaccgtcagcataacaccctgacctctcattaattgctcatgccggacggcactatcgtcgtccggccttttcctctctaaccccgctacgtgcatctatttctataaacccgttcaatttgtctgttttttgcacaaacatgaaatgtcagacaattccgtgacttaagaaaatttatacaaatcagcaatataccccttaaggagtatataaaggtgaatttgatttacatcaataagcggggttgctgaatcgttaaggtaggcggtaatagaaaagaaatcgaggcaaaaatgagcaaagtcagactcgcaattatcggtaacggtatggtcggccatcgctttatcgaagatcttcttgataaatctgatgcggccaactttgatattaccgttttctgtgaagaaccgcgcatcgcttatgaccgcgtacacctctcgtcttacttctctcaccacaccgccgaagagctgtcgctggtgcgcgaaggcttctacgagaaacacggcatcaaagttctggtcggcgaacgcgctatcaccatcaaccgtcaggagaaggtgattcactccagcgccgggcgcaccgttttttatgacaagctgatcatggcgaccggttcctacccgtggatcccaccaatcaaaggttctgatactcaggactgctttgtctatcgcaccattgaagacctcaacgccattgaatcctgtgcccgtcgcagcaaacgcggtgccgttgttggtggcggcctgttaggtctggaagccgctggcgcgctgaaaaacttaggtattgaaacccacgttatcgaatttgcccctatgctgatggcggaacagcttgatcagatgggtggcgagcagctgcgtcgcaaaatcgaaagtatgggcgtgcacgttcacaccagcaaaaacacccttgagattgtgcaggaaggtgtcgaagcgcgtaaaaccatgcgttttgccgacggcagcgagctggaagtcgactttatcgtcttctcaaccggtatccgtccgcgcgataagctggcaacccagtgtggtctggacgttgctccgcgtgggggtattgtcattaatgattcctgccagacttccgatccggatatctacgccatcggtgaatgcgcaagctggaacaaccgtgtatttggtctggtagcaccaggctacaaaatggcgcaggtcgccgttgaccatattctcggtagcgaaaatgcctttgaaggtgctgaccttagcgccaagctgaaactgctgggcgtagacgtaggcggtattggtgatgcgcacggtcgcacgcctggcgcacgtagctacgtttacctcgacgaaagcaaagagatctacaaacgccttattgtcagcgaagacaacaaaaccctgctcggtgcggtactggtgggcgataccagcgactacggcaacctgctgcaactggtgctgaacgctatcgagctgccggaaaacccggattctctgattctgccggcgcactcgggtagcggtaagccgtctatcggtgttgataaactgccggacagcgcgcaaatctgctcctgcttcgacgtcaccaaaggtgatctgattgctgccatcaacaaaggctgccacaccgttgcggcgctgaaagctgaaaccaaagcgggtactggctgcggtggctgtatcccgctggtcactcaggtactgaacgcggaactggcgaaacagggcatcgaagttaacaacaacctgtgcgaacactttgcttattcgcgtcaggaactgttccatttaatccgcgttgaaggcattaaaaccttcgaagaactgctggcgaaacacggcaaaggctacggttgtgaagtttgtaaaccgaccgtcggttcgctgctggcctcctgctggaacgaatacattctgaaaccggaacatactccgctgcaggattcaaacgataacttcctcgctaacatccagaaagacggcacctactcggtgatcccgcgttctccgggcggtgaaatcaccccggaagggctgatggcagtaggtcgtatcgcgcgtgaatttaatctctacaccaaaatcaccggctcccagcgcctggcgatgtttggcgcacagaaagacgatctgccggagatctggcgtcagctgattgaagccggcttcgaaaccggtcatgcctatgcgaaagcactgcgtatggcgaaaacctgcgtgggtagcacctggtgccgctacggcgttggcgacagcgtcggcctcggcgtggaactggaaaaccgctacaaaggcatccgtacgccgcacaaaatgaagttcggtgtctccggctgtacccgtgaatgttcagaagctcagggtaaagacgtgggtattatcgccactgaaaaaggctggaacctgtatgtttgcggtaacggcggcatgaaaccgcgtcatgcggatctgctggcagcggatatcgatcgcgaaacgctgatcaaatatctcgaccgcttcatgatgttctacatccgtaccgccgacaaactgacgcgtaccgcgccgtggttagaaaaccttgaaggcggcatcgattacctgaaagcggtgatcattgacgacaaactggggctgaacgcacatctggaagaagagatggcgcgcctgcgtgaagcggtagtatgtgagtggactgaaacggtcaatacaccgtccgcgcagactcgcttcaaacacttcatcaacagcgacaagcgtgatccgaacgtgcagatggtgccagagcgcgaacagcaccgtccggcaacgccgtatgaacgtatcccggtaactctggtggaggacaacgcatgagccagtggaaagacatctgcaaaatcgatgacatcctgcctgaaaccggcgtctgcgcgctgttaggtgacgagcaggtagcaattttccgcccgtatcacagcgaccaggtgtttgcgatcagcaacatcgacccgttcttcgagtccagcgtgctgtcacgcgggctgattgcggaacaccagggcgagctgtgggtcgccagcccgctgaaaaaacagcgttttcgcttaagcgacggcttgtgcatggaagacgaacagttttccgtcaagcattacgacgcgcgagtgaaagacggcgtggtgcagctacgcggttaatgttttaacgggaggcgcaatacctcccctttttgcatggtcctgtaataaccttcgatatattgcaggacattttttaaactttttgttttattttttgtttttattttttaaaggataatcaaatgtttacagacactattaataagtgtgcggctaacgctgcgcgcattgcacgcctgtcggcaaataacccgctcggcttctgggtcagctccgccatggcgggcgcgtatgtgggtcttgggatcatcctgatcttcacgctcggtaatttgctcgacccgtccgtacgtcctctggtgatgggcgcgacctttggtatcgccttaacgttggtcattattgctggttctgaactgttcaccggacacaccatgttcctcacctttggggtgaaagcgggcactatcagccacgggcaaatgtgggcaatcctgccgcaaacctggctgggtaacctggtcggttccgtctttgtcgccatgctctatagctggggtggcggtagcctgctgccggtagataccagcatcgttcactccgtcgcgctggcaaaaaccactgcaccggcaatggtactgttcttcaaaggtgcattgtgtaactggctggtttgcctggcaatctggatggcgctgcgcactgaaggggcggcgaaatttatcgctatctggtggtgtctgctggcatttatcgcgtccggctacgagcactccatcgctaacatgacgctgttcgccctctcctggtttggcaaccacagcgaagcctacacgctggcgggtattggtcataacctgctgtgggtgacgctgggtaatactttatcaggtgccgtattcatgggattgggttattggtatgctacgccgaaagcgaatcgtccggttgcggacaaatttaatcaaactgaaacagctgccggttaattactaaggggtttttacgtggatcatttgcctatattttgccaattacgcgatcgcgactgtctgattgtcggcggtggtgatgtcgcggaacgcaaagcaaggttgctgttagacgcaggcgctcgcttaacggtgaatgcattagcgtttattccacagttcaccgcatgggcagatgcaggcatgttaaccctcgtcgaagggccatttgatgaaagccttctcgacacctgctggctggcaattgctgcgacggatgatgacgcgcttaaccagcgcgtcagtgaagccgctgaagctcatcgcatcttctgtaacgtggtcgatgcgccgaaagccgccagctttattatgccgtcgattattgaccgctcaccgctaatggtcgcggtctcctctggcggcacctctccggttctggcgcgcctgttacgcgaaaaacttgaatcactgctgccgttgcatctgggccaggtggcgaaatacgccgggcaattacgcgggcgagtgaaacaacagttcgccacgatgggtgagcgtcgccgtttctgggaaaaactgttcgttaatgaccgcctggcgcagtcgctggcaaacaacgatcagaaagccattactgaaacgaccgaacagttaatcaacgaaccgctcgaccatcgcggtgaagtggtgctggttggcgcaggtccgggcgatgccgggctgctgacactaaaaggactgcaacaaattcagcaggcagatgtggtggtctacgaccgtctggtttctgacgatattatgaatctggtacgccgcgatgcggatcgcgttttcgtcggcaaacgcgcgggataccactgcgtaccgcaggaagagataaaccagatcctgctgcgggaagcgcaaaaaggcaaacgcgtggtgcggctgaaaggtggcgatccgtttatttttggccgtggtggcgaagagctggaaacactgtgcaacgcgggtattccgttctcggtggttccgggtattaccgcagcttctggttgctctgcctattcgggtattccgctcacgcatcgcgattatgcccagagcgtacgcttaattaccggacacttaaaaaccggtggcgaactggactgggaaaacctggcggcagaaaaacagacgctggtgttttatatggggctgaatcaggctgcgactattcagcaaaagctgattgaacacggtatgcctggcgaaatgccggtggcaattgtcgaaaacggaacggcagtcacgcagcgcgtgattgacggtacgctcacgcagctgggcgaactggcgcagcaaatgaacagtccatcgctaattattattggtcgggttgttggcctgcgcgataaattgaactggttctctaaccattaatttaaccagggccagagaagtctggcctttttcgtttacaactctctttatatattcagcagataaaaagatacccccttaataaatattgtctgctaatgggttatattcaccgttacagcgacttacaaaattaaatcaatcgctcactgacgctaattgaatattcctgtatcgttcttaatgagcagtctgcttatattcatataatcaatgaatattaattaatatataatacatagggaatgtaaatgaacaaatttattaaagttgcactggtaggcgcagtactggctacgttaactgcatgtactggtcatattgaaaaccgtgataagaactgctcttacgactacctgctgcacccggcaatttctatttctaaaatcattggcggttgcggtcctactgcacagtaagtctctgacagaaatcggctaacaccggtttaattgcctgacgccctcggggttacccgagggcgtatttatttctgcattcttttcgaaaacatcatgcacaagattaaatactggcaatactctcacgcaaaatccgcagcaccgtctcttcaccgctgcgatttgggttaatacgaatcgcataatgttcgagttgcggattcacctggcgaaacgttccggaaagtcgataaaagagcggtggaatttcatatttcgactctgcaccaaccgggtaaggcaaggcaccgcgcttttgcgcctcttccagcactctggcggcaatcggctgatgaaactcgacaatcaacaccttcgactgtgcattggcaatgacggcgcttttcacttccggaactgcaccaccgttgagcaaggccagcaaccgttcagatacccccgcctgcaccgcgtgcatcactggcgcaaacaccagcccacgcaagacttccaacgcctgagcgccctgaatctggctgccgccggagtagagcgtggcgcgaatacggttaataacatcagcatcgcctaccaccgcgccaacaccctccggcccaaacagcttgaagcaggaaaaagtcgagacatttgccccgcattcgcagccaattcgcgctaccttcatcaccgcatagttgtcatcggttaatgcaggaacgccagccgagcgcaacgttgccagcacatctgccagaatgtacccgtcctgcggctgctggcgcgtatgctgcaccagcgcggcatctggttgttgctcgtcgacaacctgcttcagtgccaacaggtcattgaaatcagcagtgataagcgtcagccccatctgctcaataatgacctgagtcgtcgggtaaaccggcgcgtcatgcaccagaagacgctgccccggtttgagcaaagccgccaacgccgcacggatcgcgccagtacccgcgccctgtaccagcgccgcagcctgtgcgtgaaatgcatcagccagcacctgttccactcgctgggtaatgcgcggttgattcagccccggcgttaagcccaaatccccgcgggtaagaaactcgctgccgggaaaatggcggcaaatcgtgtccaccagcgcaaactgcttttgctgcgcctcaataagcgtcaggctttgcaaaggatacgtcttcataggtgccttccttaagccggaacgaacaggccaaaccagtaaagaacattcagcagaataccggtgatcattactgccacgaccggtgccgccattttctgtaccggacggcccagggattcgttgaggaagtaaatggcaactgcgatagaaaatccagtataacccgccattttaattgctgcgaaaatcgaaccgaccagcaacgccacttccatcagcatattcatggcgttacggatgttatctgacgcattacgcaccgacggatagcgccccagccatttgccgatcgaacgaagcagcaggacttccgccgaaataaccactgcgcctaataccgctgcaaccatcagattcggcgagagatagcccaccgcataaacaaaggtaaagcccgcaactgcatacacaccagtggctaacgcggtggtggcaatcaacggtacaaaacccagcccgcgcataaattccgccagagctgcctggttaatcagcgtttgtgattgttccggcgttacgcctgcggaatatgctttctccagtgtgaagatcgacacttcactgccagcaaaaatcttcatgctggcaacggcggcaatcagcgccccgacaatagcgatatacggtaagtttttgataatccgcgacgtgcgttcttcaaacaccgaaagcccgctggcatcaatatcattttcatcacgatgacgcaggtcgtgagttatcgcgatccccagcagcatcaccatgccaataaagatttcgatggattccggattgagatgcgggaaatagcgcactaccaccacacgggtcatcagtaccaccacggcggcgatcagactttgcttccagccaaactggtagaaaatcgccaccaacgggaacagtgcaaaagctgaaaccaccggtgagcttaattcccccaggctacctaatacatccaccggtagcgcggtcagcagctggtttaccggcaacaggcaagtaaggatcaacacgccccagatagcgccaagaccaaacgccatcaggctgtttatcgccagtacgccgaggatatcggtaggaagaaagagtaaccatgcgttgagcagcccggttttcagggtaaacgagatccccaccgaggccacaaaaccaatgctcagaccaaaagcgatactccccgcctcgcgacggttcatatagccttcaatcagttgcggcaggatcgggcggataccgtcatgaaaaacggccgccgagcgatgcgccagaagcgatgtcatacccgtcaggcacgccaccacgataatctgaatatacagatccatagtcgtgccttttatttcagatggttaatcagcatcggaatcgcgtgttcgacatgctcaacggaaagcccaaacgccactttcccttcggcgatcattttggcgatatgttcgtctttcgctttaatgcctggtttggcaatggtgcaacttttgttatagccaatcaccgcgatggcaatcgacaatgccgcgcccgcaccggtattacacgcgccgatgtagtaatccagttgcccggatttcactttcattgccgcttccatgtcgttgtgaatgaaaacttcaaaacagccaggagccgtcgcttcaatggtttttttaatctgctcacgctgtaagcctgcaacaccaatctttttcatgagtctgtccttattggaaaaattgagagggagtttcacgtaacatcacatccacatcggcctgactgaatcctgactggcgcaattgcggaataaaggtggtcaataaatagtcatagccataaccaccgttggcttttaaatgggagcggcgcgtaatatccatcgacagcatgacgcggttcagcaaaccacggtcacgtagtgcgtggagcatcgcaatgcgcttttcgtccgggtagtaactgttcttgccgatggtgtcgaactgcacaaacgcgccgagatcgatcatcttcaaaatgttgtcgaggttgtctttcagatcgcagtgaccaacggtgacgcgcgaaagatcaactccgtgggcttgcagtagcgccagttgttccagccccatggtgctaaaagaggtatgcgtggagatcggacgtccggtctggttatgtgccagcgcggcggcaataaacaccttctcttccagcggcgtaatcttcccttcgctggagccgatctccgcgatgatcccggctttcagctccgtgccatcgataccctgttcaatttcatcgaccatctcctgcgccagttcctgcacgctgcgggtcgccacatgttccgggaaaaacgcgtcctggtaataaccggtgcaggccaccacgttgatccccgtcgcgtgcattacatcgagcataaattgcgcattgcgccccatgtaacggttggtcatctcaatcacattacgcacgccccgggccatcaggtcgttcatctcctggcaaatgaacgcatactgatcaaggcggcagtccacgttgtttttaaagccggagagatcaatatgcagatgctcatgggcgagggtgtagcccgtcggatcaaaactcatagggtgtctcctgcaaaccggagggaggaaagaaaagagcgaccattttgtggcggtggcgcacggaaaaattcacatacggtagcccccacatcagaaagcgtggtgcgcacaccaagctgcgtagcgaccatcccttgctgataaaccagcactggcaccacttcgcgggtatggtggctgtgaccaatggtcggatcgttaccgtgatccgccatcacgaccaggcaatcatctggctgcatcgcctcaataagccgggcaaggttacggtcaacgacctgcaaacgttccgcataacgtgcgacgtcttctgcatgaccagcgaggtcggtttcctggatattggtacaaataaacgccgtcggatgggtgttaaattcgttgagggtgatatccataatccgctggctatccaccaggttttgccagctcacgccataaggattactggcaatatctgccactttccccaccagcacggttggtacgcccacttcatacagtttttgcggcacctgcactttttcatcaacaccgtagcccatatgcacgacctggaagccgttgtcataagcgcctgaacgcggcgcattgatgccaataaagcgctcttctttactttctgcggcatcgagaatgcgttgactgtcgagtaacaggccgccaaatgtaatgacccgaccgacctgtacctgctcacgcacaatacgaccaattttgattgcgtcgtcaaaagagatcacagagagattggcggtgatgttatagacctggcctaaatccgcctcgagattatcgccaatcgcaaccgcctgattgacccacagaaattgcagatcatcgccaccgcgctccacctgccagcctgcggaaactaatgcctgctcaacacggtcaatcacatcgcgaaagggcatccgcagcggcggtaacgggcgcgtacctaaaatctcctgatgccccataaaggtatcgccaccttcatgttgcagctctgccacaccccaggttgcggagtctgacggctgcatatcgccaggcgcataacccaatgcgttgattagccccagcttctccagcgctggtagctgcaaatgcggcaactggctcaggatgtgaccacaggtattcgccccggcatcctgcggacgcaccaacgtgacatctttcattgcccctacgccaaagctatcaatcactaacaccacaaatcgcgccattacgcccccagagagtttccaagactgtcataacgaccgacgatttctggttcgccacggtgaataccggacagcaacaccacatcgctacgggtgacaaaaatctgcgtgcgaaaacagagcactactgcactgcttaccggaaactcgcctgccagcggcagggtgtagtcgatactgctgtcatccacagttttgagattggtttcagtaatcttttgattttctggcgtaaacaccagcgcatgttgcgcatgaccacgacggtagtaaccgccgccgtagcagtagctgtcgccacggaaatgatgggagatttcacttaaccagagcatcgcgatacgttcaggctgatcgccctgctggtttgcaggaatagtgcccgtcagcgcatgaccgggttcggcatgagtcacaccgtattccgccagcaatggcagcgaagtgcagctggtcgctgaaggcgcgttcagttgctcaatcgcaataccagatttcgccagttgatcccgtgcttgtaccagcgtgtgaagattcggtgtcggcaaagctttcccggcagcctcatcccaaagcaggcaagggaaatgggttaatccggctaaatgcagccccggcagtttcttaatttcagcaaccacctcgtgcagcgaatgctgtacaaaaccgctctcctgccccggataaagaaaatcatcgtcgctataaactttgagcagcacagactgcacacgtccggccttcaccgctgccgcagaaacttcccacgctttgtcgagagtaaacacggtgataacgtcggtgccctgttcaacggcgtcagcaacctgatgacaagggatttgtaccagatgcccctgatgcgccaccggcaaaccggcgcggcgcatgactcgcgcctctttgtaatccaccaccacaatgccgctgtagcccaatgccagcagtttttccgccagccacggattacgaccgaattgtttggtcatcagatacagttcaatgccgtaaagccgcgccgtctcaatcagccgcttaccgttttccagtatctgatccacgtcgatcacccagctgtccggggcgatcttgcccttttgccacaagcttagtgcggcggaaattagcgccgggttctggcgtttcaatgcttctacaaacatcttgttgcctcgtttctgttccttgaattaaatattcatttttttgaatatttaggttgtgcgacgtggatttgtcgggagcttcaaacctcttcgttagcagccatccataatccataaaggttggccagcaaatagccttcttcacacggattaacttccagtgtaaattccttcaacaacacctgatgcaattgcacaacggcttgccagtggctggattgcgccagttctgccagcaattcggcgtccagcggctctatttcttcaccacgacgactgcgcatcagtgcgctcgccatatgtgtcatcgccatcattccttgctcgctgcgcaccggtagatgacactctgtttccagtaagttgacgacctgcatcatgcctttgcagatgtccttatcaataacgcctgcatcgcaaagcaggttgagtctggtttccatttcagatgcctttcgtttaataactgggttcctgttccccactgaccactcgttgttgatgggcaagcagggcctgtttatcaacaactgcacgcagcaattgttgcatcgggtaatcatcgactcgcgtcaaaaccacggcttcggtggcctgtaaaaatcgcggatcgtctgtgagcggcgtcgcctctaatcccagcatggtcagttcgttttccgccaccacgttccagatcaccgcatcgacatcgcctttaacaatgcgttgtaaactctcgtgataagagagatcgacacgttccacatcactatcgccaaaaaagacatcggtcatgattttctgatccgccgaacggttatccagccctacgcgcttcacgtttgcggactcgcctttacggcaaatcaactggtgctcgccaacgtaggtgtgcggccccaactccagcgcgaggcataagcctttttgcgtgagataactttccgccgccagtcgggaaacaaccgccatgtcatacacgccgttaagtaaacactccacgcgaatatccgcgccgcgcatatgcgcatagtaaaaaggaataccatcaaactgagctttcaatccgctcgccaggccttcgtacaaacgggtatagggcaagggcatcgcgcacaccacattgttgatatccacatgactcagcaatgctttgttatccatttccaccagataactgccattacgcccacggcgttctatccgtatcgctccgcttgattccagcgttttcaacgcggcctgcgtcaggccaacggatgaacggcattcagttgccagttcatctatggttttcagtcgattaccgcacttttcacccaacaaataacgggccagtgtcgtgatgacgacgccttcttttttgataaacgttcgacgcatagtaaattttcaataaagtgaatatttatatcttcataaaaatgaagataagtggcaactgcgagatgtggaaacggcgagacgcttcacattttttcggattattgcaaatgaggataaaaaaaccgggtttccccggtttttggcattaatgttaaattacggcttcgccacaaaaccaatcgcttcgtacaccgcttttagcgtacgggaagcgtgtgcgctggctttttccgcgccatctttcatcacctgttgcaggaaggcttcgtcattgcggaaacggtgatagcgttcctgcaattcagtcagcataccggaaacggcatcagccacttcgcctttcagatgaccatacatcttgccttcgaactgtttttccagttccgggatgctctggcccgttaccgcagaaaggatatccagcaggttggaaacgcccgctttattctgcacatcgtagcgaactaccggcggctcgtcggagtcagtgaccgcgcgtttgattttcttcactaccgatttcggatcttccagcaggccgataacgttattgcgattatcgtcagacttggacatcttcttggtcggctccagcagcgacattacgcgcgcgccagatttcggaataaacggctccggcaccttaaagatctcgccatacagcgcgttgaaacgctgggcaatatcgcggctcagttcgaggtgctgtttctggtcttcacccaccggtaccagattagtttgatacagcaggatgtccgcagccatcagcaccggatagtcaaacagaccagcgttgatgttctcggcataacgcgcagatttatctttaaactgcgtcatgcggctcagttcgccgaagtaggtatagcagttcagtgcccagcctaactgcgcatgttctggtacgtgggactgaacaaaaatggtgcttttctcaggatcgataccacaagccagatacaaggccagcgtatccagcgtcgctttacgcagcttctgtgcatcctggcgcacggtgatcgcgtgttggtcaacgatacagtaaatgcaatggtagtcatcctgcatgtttacccactgacgcagcgcacccatgtagttaccaatggtcaattcacctgagggctgtgcgccactaaaaacgatgggcttagtcatttttcgattcctgattttcgctatgcggaagccctaatgcgggcagaaggtcatttatagactgataaattacatcaggctggctgagatcgatagcctcgccgtagttatatccgtaggttaagccaactgatgggcaacctgccgcttttgctgcctgaatatcattgcgtgagtcgccaacaaacagcatctgttgtggggcaattcccatccgctcagccaccagtaacagcgggtccggatgcggttttttgttttgcacatcatcaccaccaatcaccacgctgaagtatttagcgatatctaaggcttccagcagcggcgcgacgaacggcgtcggtttgttggtgaccaggcccaacggcaggcctttagcctgcaatgcgcccagcgtatcggcaacgtgcgggaacaaaaacgtcccctcttcggcaacctcgccatagtagcgatcgaacagtttacgcagaatacgtacttgttcttctgccggaatgtcgtcatcaacgggcggtttacccattgttttacgcagagtcgcacgttcctgacgcgcccaggtcaatgcgcgctccatcagaacatctgcgccgttaccaatccaggtaataacgcgttcttcacctgcaacaggcaactccagcgcatacagcgccatatctaccgcagcagcaagaccaggagcactgtccaccagcgtaccatcgagatcaaaagcgacgccgcgaatatcttcaaacttattcatgacttacctttgccagttcactgcgcatttcatcaatgacttttttgtagtctggctggtcgaagattgccgaaccggcaacgaacatatccgcacccgccgcagcgatttcgccaatgttgttcaccttcacgccaccgtcaacttccagtcgaatgtcaaagccagactcgtcgatacgacgacgtacttcgcgcagtttatccagtgtttgcggaatgaaagactgaccgccgaaacctgggttgacggacatcagcaggatcacatccaacttatccatcacgtaatccagatagctcagcggtgtcgccggattaaataccagacccgctttacagccattttctttaatcagttgcagcgtgcgatcaacatgctcggaggcttctggatgaaaggtaatgatgctggcaccagcggcagcgaaatcaggcacaatgcgatcgacgggtttcaccatcaggtgtacgtcgataggggcggtaatgccgtagttacgcaaggatttcagcaccattggcccaatagtcagattgggaacatagtggttatccatgacgtcaaaatgcacgacatcagcgccagctgccagggcttttgcggtatcttcacccaggcgggcaaaatcagccgacagaattgagggggcaatcaaatactgtttcatccgcttctccttgagaattattttttcgcgggtgaaacgactcctggtttgtacaaagccagcagttcgtccacctttttacgtgtgccgccgttgctgcttatactgcgtcgaactttgacgacatgcaattttgcgcgctgataccactcacgcgttaacatcgtatcgtgattggagatcagcactggaatatggcgatcaaccagaccttcggcgatctccgccagatgcgcttgttgttcaagcgtaaaactgtttgtgtgatacgccgtaaagttggcggtcgcagacagcggcgcataaggcggatcgcaatagacgacggatgcatcatctgcgcgcgccatgctatcggcgtaagactcacagtagaaaaaggcattctgcgctttttcagcgaagtgatacaactctgcttccgggaaatagggttttttgtagcggccaaacggcacgttaaactcaccgcgcagattgtaacgacacaggccgttgtaaccgtagcggttcaaatataaaaacagtaccgcccgacggaacggatcctggcttttgttgaactcttcgcggaactgatagtaaacctcggcgcaatttgtttcgggaataaacagctcgcgtgcggcctgtacgtactcatcagtacgcatcttcacaatgttatagagactgatcaggtcgctattgatatcggcaaggatataacgagaaaagtcggtgttgagaaacaccgacccggcacctacaaaaggctcaaccagacattcgcccttgggcaaatgccgtttaatatcatcaagcaggggatacttgccccctgcccacttcaaaaaagcgcgatttttcttcatgctgactaactaattacaccttctccggctgtggagaaagctccgacagcatccagcgcttcaggcaactcccgcaacgataaaccattgcgggagataaccttgattacttcagatcggcctgtacctgacgcagcggtttcgcccacgggtttttggcctgaacatctgctggcaatgtagataccgcttttttcgcctcttctttcgaagcgtacacgccagaaaccaggacataccacggctgaccattacgcgtcgtttcatagacaacgtagtttttcagattctctttcttcgcccaaccgttcaggttgtcgtagttagaggaactgctcagctgcagagtgtaatggctggacggtgccgatttcaacgaaccaacattacctgcggtcttccctccagcggctggtgttgccgtggtttgcgccggggatgccgtctgtactggagccgtagttgcggtctcttttggtgctggcgtagaggtcgcagccggtgccttcgtgcttgccacaggagcagctggttcagtacgcttcggcgtctgtgctaccggcttcggctccgtttttacggttgcttgcggttttttcggttcaatcaccgcctgctggcgagctggacgcgtagtggccggacgttcagcggtttgcgttttcgccgtgtcacgcgatgcattgccattgcgaacaggcgcgaccgtcgcgggttcagtcggcaacgtggaattgaccgccacattgttcaactgttgctgattttgtggctgggtcagcgcattgttcaggtcaccctgcacttcaacacgttgttgaccatccgttgccgccggggtttgcccttgagtcggcgtagaagagatcggcggcagagatacatcctgctgagtattttccgcagacgtggttcccggcgctggctgcacgccattcgcctgatcggtcgcattgccagcaagatcaatactcttctcgccagacgcagtttgatcgctggaagaggtcgagggggcttttagcgcagaaccgataccgataatcaacagcaggagaaccagaatgccgacgcccatcatcatatactgacgagaagcgggtttactggctgcttttttgcgcttacgcggacgacgctctacgcgctcttcatccacggtttcatcttcggattcgtcaatttcttcttcgagttccggttcctcattgcgctctttttgcgcacgagtcggacggcgatcgtcagtgtcatcaagttcaatatcatcaaaattgatctgcggttcgccacgttcagtacgctcagaacgttcagaagattgacgagaacgaccagtacgacgatcgctgggatcgggtttcagctcgtcttctggtttgaattcatccatttaacaccccactaaaaggttaatgcttaccacgttgcaattaacctgaagctaatagaccgcttgataagcggcctgacctttcttgttgttacgctgattgacaatcggcaatggcgttaagaacaagctcgtgcgaaacgccgctgcgaacttcactcttaccaattgccaacggaagaattaagcgcatctctcccgcaaggactttcttgtcacgcagcatgtgcggtaaatacgcctgcgcagacatttcgcgcggcccattgaccggtaacccagcccgcgtgagcagggttataatacgctgcgtttcggcagaactaaactgcccgagacgttccgacgtccgcgccgccatcaccatacccgcagcgaccgcttcaccgtgtaaccaattgccataccccatttcagcttcaatggcatgaccaaaggtatgtcccagattcagtaaagcacgtaacccggtttcgcgctcgtcggcggcgacaacttctgccttcagttcacaacaacggcgaatacagtacgccattgccggaccgtccagacgcaacaacgcatccagattctcttccagccagttgaaaaacgcaccgtcaagaataatgccgtatttgatgacttctgccagccccgacgctaactcacgcgggggaagcgttttcagacagtcgagatccaccaccactgaagcaggctggtagaacgcgccaatcatgtttttaccgaggggatggttgaccgcagttttgccgccaacggaggaatcgacctgcgacagcaacgtcgtcgggacttgaatgaaacgtacaccgcgctgataactcgccgccgcaaagccggtcagatcgcccactacgccgccgccaagcgccaccagcgtagtatcgcgaccatgcggcttttgtaacaacgccgtaaagacggtatcgagtacagccaggcttttatactgctcgccgtcagggaggataacgctatcgacgttaacacccgcctgttcaagtacgccgcggaccttatcgagatacagaggagccagggtttcgttggtgaccaacatgacctgctcgcccgatttcagcggtaagaatgaagctggttcattaaacaaaccagatgcgatggtaattgggtaactacgttccccgagagtaacgacaatcctctccataacgcgacatccaccttaattactgtacccgcagacgagtgtatataaagccagaattagttgctttccagcatgtgaataatctggtttgcgaccactttagcgctttgatcatcagtacgaatggtcacgtcggcaatctcttcatacagcggattgcgttcattggccaacgcttccagaacttcacgcggcggtgtttcaacgtgcagcaacgggcgttttttatcacgctgcgtgcgtgcaagttgcttttcgatggtcgtttcaagataaacgacaacgccacgtgcggaaagacggttacgcgtttcgcgggatttcacagagccgccgccagtagccagcacaataccctgtttctcggtcaactcattgatgaccttttcttcgcgatcgcggaagccttcttcgccttctaaatcgaaaacccagcccacatcagctccggttcgtttctcaatctcttgatcggaatcgtagaattccatattgagttgttgagctaactggcgcccaatagtgctttttccggcacccataggcccaaccagaaagatattgcgtttctctgccattttttcggtactactaagactattcgttaatgataaacccgcttcgctcagagagcgccgcaggacatgaactgaaacctcataagatattgcgagagtcagactgaaaattatctcaatactccagcgggtttggcaactgaataaatcacccatccctctgcatatctggtcgctgcaagcgcgctgccttgctaccaccgctctggcgataaatcaccgggtaagattagcgtaaaaaagacagcaaaatgccgcctgaatgataaatcatcatcatggaacgcaggcagcgaagagcaccaactctcaaatcggtactccttgtatgctaaatacctgcgcgcgtcaaatagatgaaacacgttcagcgcaaaaacattaccgcttttacggctgtttactcactggaaaccagtcgtggcgtgataaacaccactaactcgcgtcgttcatcttcttttccgtcatgacgaaataattgcccgaaccagggaatgtcgccaagcaacggtacgctatcctgacccgatttatttttacgggtaaaaatgccacccagcgccaacgtttctccgcttttgacctcgacctgcgtttcgatctcctgcttatcaatcgccagcacttcgccatcggcctgctgtagcacctgccccggaacgttctggctgatgtgtaatttcagccggatgcgacctttttgtaacaccgtgggcgtaacttccatccccaggacggcctctttaaattccaccgacgtcgcgccactttccccgctggaaacctgatatggaatttcgctcccctgtttaatgctggcaggctgaagatgtgaggccagcagacgcggactggcgataatatccagctgctgtttttgttcgagcgcggaaagctcaagatccagtaaacgtccgttgatgcgtccaatgttaaaaccgacatgcgttgtcgccgtcgctacggagaggtcgctgccaagcgtggtgacttgcccaacgccaccagcttgttgcgcatcagccaacgtccatttcacgcctaactcacgcaaacttttttcattaatggtgacaatatgcgccgacagctcaacctgcccgaccggcagatccatttgcgctacccactgttcaagcgcgcttaacgccgctttgttatctcgcagcaaaaggcgattggtgcgtttatcgacggtcatactccctttggcactcagtagcttctcccccgctttcgccagctctccggcgtcggcgtattgcagagtaatattgcgattttccagcggcagatttgcctgcgcccgcgcctgctccgcctcctggcgggcgatattgtcattctgccaggcaacggaatgcaccgagagaatattgccttcctgccgcgttatcagtccggcgcttttcactacagtttgtagtgcttgcttccagggaacatctgttagatgtaacgacaccgtacctctgacgtctggcgacaccaccaggttcaacttctcctgttcagccagcgcctgcaacacctgagctaccggaacgtcatccaccatcagtgtcactttttgcggctttgccgcctgtacgccgggtatcagcatcaacagtagtgcggctatccattgcttcatttgtatctccttgccgttgccacaaccagtgtggcggttcgcagtttgttccggttcccagcgttagtgcgtctggcgtcagctgtaaaattgtccagccgttttccagcacatcgttttgctgcacccgtcgccatttcttttgcccgtcttttattacaccgatgatgcgctcgcctcgccctactatcccctgatagcgccactggctaagctcgctaatccggcatagatcttccggcggtttaaaagggtcacgcataccggttaaaaggcacaatgcaatacctgccaacaaccagcgtttaaccctcatccggtgtctccagttgtagcgtgaacaaaaggtcatcaccttccacgcttaacgaaaaacggctcacgctgacgttgcgctctgccagccgtgtaaatgccgacggcactgcttcccacagcgttttcaacgccaactcacctccctgcgcggatggatgccaggaaaccagttgcgcgccggataactgaaaatccagtggcgaaaagggcagcgttttttcttcgctgaagggagtggtgtctaccaggcgatacagtgcggcccactgctggtgatgactcgcccgtagtcgaattaatgcgtcgctctcttcctggtgtgtcgatgacagaaaaatgagcgtaactaacatcagcaaccagaatgcccagcaaagctggcggaggcggggtgatgtggcgaaccaccagtcaaagagcatgtccatcgctaaccttccttgttaactgatactcaaattgccagcgtccctgcgcatcctgctgcgtggccccccgctgattgagatgaaaagatgcatcctggcggagtgacgtttccagcgcgtttaacgcggtaatgcttgttgtcagccccttgatctccagcgttccctgctgccagcttatcgttgtcagccaggcatgttcgggtaaaagcgccgccagtgcttccagcgcagattgccagtcacgggtaaattgtcgctggagctgcctttgcaaacgctgttcgcgtaactgctggcgttccagcaaacgtggtttcgttatctgtaagctgcgggcgagttgttgttccgcctgaagcaaaacggtgtctacgcgtgcttcggcgttgcttgtcagacgcagtattagcgttatcccgacagccagcagcagaggcgcaacgaacatcagcaaccagaaacgaagaaaagcggtccggcgttgctgtcgccagggcaaaaaattaattggcgggttcatcagtacaccttcccaagcgccagccccagcgcgatggcaaagtctccacctggcggcggtagcggcggctgacgaacagaaaccgcctcccaggggtcaaatccgccttcgccacatatcgcgacgctttcgggatcaacggataacgctgccgccagctccttcgcgctagttatccccaccgccagtttgcgcccccagctatagcgcgtcgcccacagccactgttcgttatcacgccaggccagacattgctgatgagaaggtaaaaaaggcaggaatcgctgtaatgcactggcatccggggtgatcgcgctaacatgaacacgcaacctttctgccagagtaagcagcgttgccagctctttgctttgcgcggcagtcacgttataggcgggactgagtgagtcttcgctgtaatcgaagcgcagggagtccggatccatatccagctcgcgggccatcgtcccggacagccaggccgtttgctcccgctcaccaagggacatcgacgggcgtggaaatgaccgctgtaatgtgcgactggcgggaaatgccaacataatgtgatgacgctgcggcagttcgcgactccacggtaacaacgttttagccagccgctgtgcatcgacaatccgcccatctttgattatgtcgttctccagcggcaaccgccaccagcgttgcaaaaagcattcttttgtgccccgcacgatagcaaccgctaccgcttcttgctgttgtaaatgcaaaccaatttgccagatcttaaatgccattgtgatgatctccttatcacccgtcactctgacgggtatatcaatgcgtctggcttgcctttatactaccgcgcgtttgtttataaactgcccaaatgaaactaaatgggaaatttccagtgaagttcgtaaagtattttttgatccttgcagtctgttgcattctgctgggagcaggctcgatttatggcctataccgctacatcgagccacaactgccggatgtggcgacattaaaagatgttcgcctgcaaattccgatgcagatttacagcgccgatggcgagctgattgctcaatacggtgagaaacgtcgtattccggttacgttggatcaaatcccgccggagatggtgaaagcctttatcgcgacggaagacagccgcttctacgagcatcacggcgttgacccggtggggatcttccgtgcggcaagcgtggcgctgttctccggtcacgcgtcacaaggggcgagtaccattacccagcagctggcgagaaacttcttcctcagtccagaacgcacgctgatgcgtaagattaaggaagtcttcctcgcgattcgcattgaacagttgctgacgaaagacgagatcctcgagctttatctgaacaagatttacctcggttaccgcgcctatggtgtcggtgctgcggcacaagtctatttcggtaaaacggtcgaccaactgacgctgaacgaaatggcggtgatagccgggctgccgaaagcgccttccaccttcaacccgctctactcaatggatcgtgccgtcgcgcggcgtaacgtcgtgctgtcgcggatgctggatgaagggtatatcacccaacaacagttcgatcagacacgcactgaggcgattaacgctaactatcacgcgccggagattgctttctctgcgccgtacctgagcgaaatggtgcgccaggagatgtataaccgttatggcgaaagtgcctatgaagacggttatcgcatttacaccaccatcacccgcaaagtacagcaggccgcacagcaggcagtacgtaataacgtgctggactacgacatgcgccacggctatcgcggcccggcaaatgtgctgtggaaagtgggcgaatcggcgtgggacaacaacaaaattaccgatacgctgaaggcgctgccgacctatggtccgctgctgcctgccgcagtcaccagcgccaatcctcaggaagcgacggcgatgctggcggacgggtcgaccgtcgcattgagtatggaaggcgttcgctgggcgcgtccttaccgttcggatactcagcagggaccgacgccgcgtaaagtgaccgatgttctgcaaacgggtcagcaaatctgggttcgtcaggttggcgatgcatggtggctggcacaagtgccggaagtgaactcggcattggtgtcgatcaatccgcaaaacggtgccgttatggcgctggtcggtggctttgatttcaatcagagcaagtttaaccgcgccacccaggcactgcgtcaggtaggttccaacatcaaaccgttcctctacaccgcggcgatggataaaggtctgacgctggcaagtatgttgaacgatgtgccaatttcccgctgggatgcaggtgccggttctgactggcagccgaagaactcaccaccgcagtatgccggcccaattcgcttacgtcagggactgggccagtcgaaaaacgtggtgatggtacgcgcaatgcgggcgatgggcgtcgactacgctgcagaatatctgcaacgcttcggcttcccggcacaaaacattgtccacaccgaatcgctggcgctgggttcagcgtccttcaccccaatgcaggtggcgcgcggctacgcggtcatggcgaacggcggcttcctggtggacccgtggtttatcagcaaaattgaaaacgatcagggcggcgtgattttcgaagcgaaaccgaaagtagcctgcccggaatgcgatattccggtgatttacggtgatacgcagaaatcgaacgtgctggaaaataacgatgttgaagatgtcgctatctcccgcgagcagcagaatgtttctgtgccaatgccgcagctggagcaggcaaatcaggcgttagtggcgaagactggcgcacaggagtacgcgccgcacgtcatcaacactccgctggcattcctgattaagagtgctttgaacaccaatatctttggtgagccaggctggcagggtactggctggcgtgcaggtcgtgatttgcagcgtcgcgatatcggcgggaaaaccggtaccactaacagttcgaaagatgcgtggttttcgggttacggtccgggcgttgtgacctcggtctggattggctttgatgatcaccgtcgtaatctcggtcatacaacggcttccggagcgattaaagatcagatctcaggttacgaaggcggtgccaagagtgcccagcctgcatgggacgcttatatgaaagccgttcttgaaggtgtgccggagcagccgctgacgccgccgccgggtattgtgacggtgaatatcgatcgcagcaccgggcagttagctaatggtggcaacagccgcgaagagtatttcatcgaaggtacgcagccgacacaacaggcggtgcacgaggtgggaacgaccattatcgataatggcgaggcacaggaattgttctgattaaaaaggcgcttcagcgcctttttcagtttgctgacaaagtgcactttgtttataccggatacggcgtgaacactttacccgtctagcaacatctagaaaaatcaatatattgcaggagccgcacaggcctgataagcattgtgcatcaggcaaacctcacgcatttacactcgcccctgccccttcaaccattcgcgcacgaggaacagcgcgctgacattacgcgcttcgttgaagtcagggtcttccagcaaatccatcatatgcgccagcggccagcgcacctgtggtagcggctctggctcatcgccttccagcgattccgggtagagatcttgcgctaccacgatattcattttgctggaaaagtaagacggtgccatactgagcttcttcaaaaaagtcagatcgttcgcaccaaatcccacctcttcttttagctcgcggttcgcggcttcgaagacgctttcacccggatcaattaatcctttcgaaaaacctaattcgtaggattcagttcccactgcgtattcgcggatcaggatcaggtgatcgtccacaatcggcacaatcatcactgcttcccggttggttggacgcattcgttcataaacacgccgcacgccattgctgaactccagatccacgctttcgacggtaaacagtcgggaacgggctacagtttcaacattcagaatggtgggtttttgtaatgatttgctcatcgtgggatctatgctgtgaaatcagcggttattgtgcgatataggacacgctttcggcaatgtgaattgcatgttatttacatttatgtaacttaataaataatcgtcctcaaatcaaattaaaagtcaataggttgaaataactccaggaatttgctgatattccgccttcagagggtttgctatgatcagcggttactgtgatgtgcttaatgatgctcaagttaaactccacgcttgccgatagccaaccgcagaatcatgtattgtgtccggtgcgactgaccacgcctgacagactaagtaagatggggaaagcatgagcaccattgtgatttttttagctgctttgctggcctgctcactacttgcgggatggctgataaaagtgcgatccagacggcgtcagctgccctggaccaacgccttcgcggatgcgcaaacgcgtaaactcacacctgaagaacatagcgccgttgaaaattatcttgagagcctgacgcaggtattacaggtgcctggcccaacgggagccagcgcggcaccgatctctctggcgctgaatgccgaaagcaacaacgtcatgatgctgacacacgctatcacgcgttacggcatctctaccgacgatccgaataaatggcgttactacctcgattcggtagaagtccacctgccccctttctgggagcagtacatcaacgatgagaataccgttgaactgattcataccgattcgctgccgctggttatttcactcaacggtcatacgctgcaggagtacatgcaggaaactcgcggctatgccttgcaacctgttccgtcaacacaggcgtcgattcgcggggaagagagtgagcaaatcgagctactcaatattcgcaaagaaacgcacgaagagtatgcgctaagtcgtccgcgcgggctgcgcgaagcgttgctgattgtcgcctccttcctgatgttctttttctgcctgattaccccggatgtatttgttccgtggctggcaggcggcgcgttactgctgctgggcgcaggactgtgggggctattcgcgcccccggcaaaatcctccctgcgggaaattcattgtctgcgcggtacaccccgtcgttggggattgtttggcgaaaacgatcaggaacagatcaacaatatttcactcggtattatcgacctggtctaccccgcacactggcagccctacattgctcaggatctcggtcaacaaaccgatatcgatatctatctcgaccgccacgtagtgcgtcaggggcgatatctttcgctccatgatgaagtaaaaaactttccgttacagcactggctgcgcagtacgattatcgctgcgggctcgctactggtgctgtttatgctgttattctggatcccgctggatatgccgctgaaattcaccctctcgtggatgaaaggcgcgcagaccattgaagccaccagcgtgaaacaactggctgacgctggcgtgcgggttggcgatacattgcgtattagcggtacgggaatgtgtaatattcgcacttccggtacctggagcgcgaaaaccaactcaccttttttaccgtttgactgctcgcagatcatctggaatgacgcccgctcattgccattaccagaatctgaattggtcaacaaagcgacggcattgaccgaagcagttaatcgccagctgcaccctaaaccggaagatgaatctcgcgtcagcgcctcattacgttcagcaattcaaaaatccggcatggtattgcttgatgattttggcgacatagtactgaagacagcggatctgtgttctgccaaagatgactgtgtgcgactgaaaaatgcgctggtcaatctcggtaacagtaaagactgggacgcgctggtaaaacgcgccaacgccgggaaactcgatggcgtgaatgtgttattacgcccggtgagtgcggaatcgctggataacctggtggccacctctaccgcgccgtttatcacgcatgaaacggcgcgagcggcacaatcactaaacagtccggcccccggcgggttcctgattgtcagcgacgaaggcagcgattttgttgatcagccctggccttcggcatcactttacgactatccgccgcaagaacagtggaacgctttccagaaactggcacaaatgctgatgcatacgccgtttaacgccgaaggtatcgtcacaaaaatcttcactgacgccaatggtacgcagcatattggccttcatccgatcccggatcgttccggcctgtggcgctatctcagcaccacgctgctgctactgacgatgctgggtagcgccatttataatggcgtacaggcctggcgtcgttaccagcgtcatcgtactcgcatgatgaagattcaggcctattatgaaagctgcctgaacccacaactgatcaccccttcagaaagccttatcgaataacacgtttgcgcggcaggttatgctaccctgtcgcgcaaattgcttcactctggagatttccctcatgcatatcaacattgcctggcaggacgtagataccgttctgctggatatggacggcacgttgctcgacctcgccttcgataactatttctggcaaaagctggtgcctgaaacatggggcgcgaaaaacggggttacgccacaggaagcgagggaatatatgcgccagcaatatcacgacgtacagcatacgctaaactggtactgtcttgattactggagtgagcaactgggtctggatatctgtgcgatgaccaccgagatgggaccgcgcgccgtactgcgtgaagataccattccgtttcttgaggcactgaaagccagcggtaagcagcgaattttgctcaccaatgctcatccgcacaacctggcggtaaaacttgagcataccggtctggacgcacaccttgatttattactttccacccacacatttggttatccgaaagaggatcagcggttatggcatgcggtggccgaagctacgggactgaaagctgaaagaacgctgtttattgatgacagcgaagcgattctcgatgctgccgcgcaatttggtattcgttactgcctcggcgtgactaatcctgactccgggattgccgagaaacagtatcaacgccatccgtcactgaatgactaccgccgcctgatcccctcgctaatgtgaaggagacgccatgaaagaaaaacctgctgttgaggttcgactggataaatggctatgggctgcccgtttttataaaacccgcgcgctggcccgtgaaatgattgaaggcggtaaggtgcattacaacgggcagcgcagcaagccgagcaaaatcgtcgagctgaatgccacgctcactctgcgccagggaaatgacgaacgcacggtgattgtaaaggcgattactgaacagcgtcgccccgccagcgaggcagccttgctgtatgaagagactgcggaaagtgtagagaaacgcgaaaaaatggcgctggcacgtaaacttaatgccttaaccatgccgcacccggaccgacgcccggacaaaaaagagcgccgcgacctgttacgatttaaacacggcgacagtgaataactgtcacctgcaagagagatgattatgccgcaacatgaccaattacatcgctatctgtttgaaaactttgccgtgcgcggcgaactggtaaccgtttcggaaaccctgcaacagatccttgagaatcacgattatccgcagcccgttaaaaacgtgctggcagaactgctggttgcgaccagcctgttaaccgctacgctgaagtttgatggtgatatcaccgtacagctgcaaggcgacggtccgatgaatctggcggttattaacggtaacaacaaccagcagatgcgcggtgtagcgcgcgtgcagggagaaattccagaaaatgccgacctgaaaacgctggtcggcaatggttacgtggtgatcaccatcaccccgagcgaaggtgaacgctatcagggcgtggtgggtctggaaggtgatactctggcggcctgcctggaagattactttatgcgttctgaacagctgccgacgcgcctttttattcgcaccggcgacgtagacggcaaaccggctgcaggcggtatgttgttgcaggtaatgcctgcgcaaaatgcccagcaggacgactttgaccacctggcgacgctaaccgaaaccatcaaaaccgaagaactgttgaccttaccggcaaacgaagtgttgtggcgtttgtatcacgaagaagaggtgacggtttacgatccgcaggatgtggagttcaaatgcacctgctcgcgtgaacgttgcgccgacgcgctaaaaacgctgccggatgaagaagtcgatagcatcctgacggaagatggcgaaattgacatgcattgcgattactgcggtaaccactatctgttcaatgcgatggatattgctgaaatccgcaacaacgcgtctccggcagatccgcaagttcattaatgagtatgtccggcagagagggctctgccggattttacgactaatacacctgatgcgctttgtcactcattcagattcacatccagcctttcaccatccactacaagatcgcgccacgctttaggcttcgttcccagttttccatccttcgcagctgtgagtaatttttctttcgttatatcacgcggaagtaaactcatcgtaagctcttgccattctttcttgtcaggatcaaagccatagacaatgtatctttcatcatcaaaggcaaagaggatccgctctgccctgccatcactattcagatcttgctcgaccagtacgcaggcgtctttttcaatacaggtcatcacgttatagcgatcctggattaaggccgaccagaatgtcgcatccggtttaccagaaccaggggcaattaacacattttcggctaatactttttccgatatctgttgctgaagatgttgctctccatctaacgccattaacagatcccgcgcgcgtttcgggtctttcataaacccggcatcgcttttcagcgactcaagcgccgcacgtccatagcgaccgctctgttcgagcatatagagacttacctggtctggcgtgtttttgccgctctgataacgcgccatatgactgttcacgctaatgcgcatactgtccagcaccggagaattaagaagcaccagtattaccaacaccaataacgaaaccgcaaggttcactttgccctgaagaacaagggggttttgccctttacgccagacgatactgacaaaataccccagcgaccataccagtaacaccagcaccgccagcgcaccctgcaagcggtcgacagtccagccgtactgagcgacccgcagccataacgcccaggcggcgacgaacacatacagcggagcaaccagcagagcggttttaatcaggcaacgcaacggccccgtccagggaagtgacgatttttgcggatcgcggacaatagccattaagatcaattgcaaaaaggccagcgtcaacagcagcccggcggcggagatgtggcgagaaatcgcgctcaggcccgtaaacggcagggtgatgataaacatcagggttagcaatgatactaacggcagcaaccccgtggcgattaacgttaacaacttttgaatagagtcgattaaacgtgactgtgttcgcgcgaggatcaccgccagcgcggtaaccagacctaacgtgagataaataaaccagtcggttgcaaaaaagagcgttttgaaaaacgtgatgccaacaagtttaaacaactcgccccacagtaaaagcaccagccacgtcaggccattggcgagaaaaatcaccagtaatataagtacgttatgccatactgactggtaaaaatagccatagcggctactgtcattgcggatgcgaaggctttgttgtatccacggtagcaacaacattgccatcagcagcagatagcagccaaaatcccaaagcgccttttctgctctccaggggttcatgccatcaatttgccactttagccaaccgctcatccctagcgtggcaataaacaccagcgccagccatccccaaaggcgcttctgtttaaaggagatcacggagaagagtaaaacggatgaaaatgcgacggtcgcaggcacgccataaacaatccaactgagattttttccggcaagccaggcgatcagtaggtagcaaaccagaccctgaagtaatccggtagcaatcatcccccagcgtgttgcgggtgaaagttcaacgttatccacgttagttatccagaatcaaaaagtgggttaattatcgcatccgggccgtagtattttgcttttttcagaaaataatcaaaaaaagttagcgtggtgaatcgatactttaccgattgaatttgcatcaatttcattcaggaatgcgattccactcacaatattcccgccacataaaccaagatttaaccttttgagaacattttccacacctaaaatgctatttctgcgataatagcaaccgtttcgtgacaggaatcacggagttttttgtcaaatatgaatttctccagatacgtaaatctatgagccttgtcgcggttaacacccccaaaaagactttactattcaggcaatacatattggctaaggagcagtgaaatgcgcgttaacaatggtttgaccccgcaagaactcgaggcttatggtatcagtgacgtacatgatatcgtttacaacccaagctacgacctgctgtatcaggaagagctcgatccgagcctgacaggttatgagcgcggggtgttaactaatctgggtgccgttgccgtcgataccgggatcttcaccggtcgttcaccaaaagataagtatatcgtccgtgacgataccactcgcgatactttctggtgggcagacaaaggcaaaggtaagaacgataacaaacctctctctccggaaacctggcagcatctgaagggcctggtgaccaaacagctttccggcaaacgtctgttcgttgtcgacgccttctgtggtgcgaacccggatactcgtctttccgtccgtttcatcaccgaagtggcctggcaggcgcatttcgtcaaaaacatgtttattcgcccgagcgatgaagagctggcaggtttcaaaccagactttatcgttatgaacggcgcgaagtgcactaacccgcagtggaaagaacagggtctgaattccgaaaacttcgtggcgtttaacctgaccgagcgcatgcagctgattggcggcacctggtacggcggcgaaatgaagaaagggatgttctcaatgatgaactacctgctaccgctgaaaggtatcgcttctatgcactgctccgccaacgttggcgagaaaggcgatgttgcggtgttcttcggcctttccggcaccggtaaaaccaccctttccaccgacccgaaacgtcgcctgattggcgatgacgagcacggctgggacgatgacggcgtatttaacttcgaaggcggctgctacgcaaaaactatcaagctgtcgaaagaagcggaacctgaaatctacaacgctatccgtcgtgatgcgctgctggaaaacgtcaccgtgcgtgaagatggcactatcgactttgatgatggttcaaaaaccgagaacactcgcgtttcttatccgatctatcacatcgaaaacatcgttaagccggtgtccaaagcgggccacgcaactaaagttatcttcctgaccgcagacgcttttggtgtgctgccgccggtttctcgtctgactgccgatcaaacccagtatcacttcctctctggcttcaccgccaaactggccggtactgagcgtggcatcaccgaaccgacgcccaccttctccgcttgcttcggcgcggcattcctgtcgctgcacccgactcagtacgcagaagtgctggtgaaacgtatgcaggcggcaggtgcgcaggcgtatctggttaacaccggctggaacggcactggcaaacgtatctcgattaaagatacccgcgccattatcgacgccatcctcaacggttcgctggataacgcagaaaccttcactctgccgatgtttaacctggcgattccgaccgagctgccgggtgttgacacgaagatcctcgatccgcgtaatacctacgcttctccggaacagtggcaggaaaaagctgaaaccctggcgaaactgtttatcgacaacttcgataaatacaccgacacccctgcgggtgccgcgctggtagcggctggtccgaagctgtaatgatttgaagctggagaatatctatccagtatcttatagaaagcaaaacgggaggcaccttcgcctcccgtttatttacccttcttttgtcgtgccctgcgcccgcgttaccggcacaggcagccaggcgcgaatggaaagcccgccccgttcgctggtgccaagctccagcatcccgttatggttatccacgatacgctgcacaatcgccagccctaatcccgtgccgctaatggtgcgcgcactgtcgccgcgaacaaacggctggaacaggtgcttacgttgttccggcgcaattcccggaccgtcatcttccacctggaaccaggcgcgattcggctccgttccgctgctgactttgatccagccattgccgtaacgggcggcgttgaccaccatattcgccaccgcacgtttgatcgacagcgggtgcattttcacctcaatgctgccggggtaaagcgcggtttcaatttcccgctcatagccactttcggcggcaatcacctcaccgagcactgcgttgagatccgccatttccatcggcatctcctgcccggtgcgcaggtagtcgataaactgctcaatgatggcgttgcactcttcgatatctttattgatcgattctgccaggtagccatcctgctcgctcatcatctcggttgccaggcgaatgcgcgtcagcggcgtgcgcagatcatgacttacccccgccatcagcagcgtgcggtcatccgccagttgcttaacaccagccgccatatggttaaaggcgcgggtaaccgaacgcacctcggacgcgccatattcacgcagcggcggcggaataattcctttaccaacctgcaaggctgcgtgttcgagatcgaccaacggtcggttctggatacgaataaacaaccacgccccgcctatcgccaatagcataatcgccaacgtatagcggaacagcggagaaaaatcgccctgatgaatttcggtcagcggcacgcgcacccagatattgggcgacagccaggttttcagccagacgacaggcgaacttttgttgacctcaacgcgtacttccgtcgggccgcccagttgctgcgccatctgatggcttaagaattcatagtgttgtgcccaacgcagacctgcctcttcagcagcttcgttggagtagagagagatccccagctcacggtagatctcccgacggaaagcgggaggcacaaccaactgcgtaccgtcctccagttgcagtttgtcggtcatcaacatacgcacttcgtacgcgaggactttattaaactgctggaggctcggcaaaatcgcgaagttcagcaccaccagataagtcgtcaccaggctgacgaacagcaaggtgacgatgagcaataacgtacgggcaaatgaacttcgtggcgagaagcgcaatcgcctcatgctttagaaccgtccggtacaaagacgtagcccagaccccagacggtctgaatgtaacgcggatgcgccggatcttcttccaccatgcggcgtagacgcgaaatctgcacgtcgatggagcgttccattgcggagtattcacggccacgggcaaggttcataagcttatcgcgggagagcggctcacgcggatggctgaccaatgccttcagtaccgcaaactcaccgctggtgagcggcatcggctcatcttcgcggaacatttcacgcgtaccgaggttaagtttgaacttaccgaaagcaattaccgcctcttcctgtgacggcgcgcccggcagttcgttggcctgacgacgcagcaccgcacgaatgcgggccagcaattcacgcgggttaaacggttttggaatgtagtcgtcagcgccaatctccaggccaacgatacggtccacttcttcccctttcgccgtcaccataatgatcggcatcgggttgctctggctacgaagacgtcggcaaatcgacaagccatcttcaccaggtaacatcaaatccagtaccataagatggaaagattcacgagtcagcaggcgatccatctgttctgcattagcgacgcttcgaacctggaagccttgttcggtgagataacgttccagcagcgcgcgcaggcgcatatcgtcatcgaccaccagaatcttgtagttctcttgcattgtttgtactcccaaaggttcgcaacaatttgtaagcgtgtattcttaaaaaagctcacgttcgtcaccagctaaatctggtatgaatttcagcctaaattgttacaaagcatattaaacagcagcttaagtatacaatttattcggcgaaacattattgattctgttgatatgatcacgttatacccaatgtgcgcattatcaaacagacaaagggaatcaacgagatgaaaacgcccctggttacccgggaagggtatgaaaaactcaaacaagagcttaattatctctggcgtgaagaacgcccggaggtcacaaaaaaggtgacctgggccgcaagtctgggcgaccgcagcgaaaatgctgactatcagtataataaaaagcgcctgcgtgaaatcgaccgtcgcgtgcgctatctcactaaatgcatggaaaatctcaaaatcgtcgattactccccgcagcaggaaggcaaagtcttttttggtgcgtgggtggagattgaaaacgacgatggcgtgactcaccgtttccgtattgtcggctacgatgaaatttttggtcgtaaagattacatctctatcgattccccgatggctcgcgcattgttgaaaaaagaggtgggcgatttggcggtggtgaatacccctgccggggaagcgagctggtatgttaatgctatcgagtacgtgaaaccgtaaggaagagtcttaacctcctgccgatggctggcatttttgccagccagtccgtataactatcccctgatttttgatccgaaaagatgaactcaaaccatgatgaatgattcgttctgccgcattattgcgggtgaaattcaggcgcgcccggaacaggttgacgctgccgttcgcctgcttgacgaagggaataccgtgccgtttatcgcacgttatcgtaaggaaatcaccggcggtctggatgacacgcagctgcgtaatctggaaacgcgtctgagctatctgcgcgagctggaagagagacgtcaggcgatcctcaaatccatttccgagcaaggcaaactcactgacgagctggcgaatgccatcaacgccacactaagcaaaaccgaactcgaagacctctacctgccctacaaacctaaacgccgcacccgcgggcaaatcgccattgaagcagggcttgagccgttggctgacctgctgtggagctctccatcacacacgccagaagtcgccgctgcacaatatgttgatgccgataaaggcgtggcagataccaaagccgcgctggacggcgcgcgctatatcctgatggaacggtttgccgaagatgccgcgctgctggcgaaagtgcgtgattatctgtggaagaacgcgcatttggtttctacggtggtgagtggtaaagaagaggaaggggcgaaattccgcgactatttcgatcatcacgaaccgctgtcaacggtgccttctcaccgcgcgctggcgatgttccgtggtcgtaacgaaggcgtacttcagctttcgctgaatgccgatccgcagttcgatgagccgccaaaagagagctattgcgagcaaatcattatggatcatctcggcctgcgcctgaacaatgccccggcggatagctggcgcaaaggcgtggtgagctggacgtggcgcatcaaggtgctgatgcatctggaaaccgaactgatgggcaccgtgcgcgaacgcgcggaagatgaagcaatcaacgtctttgcccgtaacctgcacgatctgctgatggcggccccagccggactgcgtgcaacgatgggcctcgatccgggtctgcgtaccggggtaaaagtagcggtggtcgatgcaactggcaaactggtggcgaccgataccatttacccgcacaccggacaagccgcaaaagcagcgatgaccgttgctgccctgtgtgaaaagcataatgttgaactggtggcgatcggcaacggtacagcttcccgcgaaactgagcgtttctatctcgacgtgcagaagcagttcccgaaagtgaccgcgcagaaagtgatcgtcagcgaagcaggcgcgtcggtttactcggcttccgagctggcagcgcaggagttcccggatctcgacgtttcgctgcgtggcgcggtatctatcgcccgtcgtttgcaagatccgctggcggagctggtgaaaatcgatccgaaatctatcggcgtaggtcagtatcagcatgacgtcagccagacgcagctggcccgcaaactggatgcagtagtagaagactgcgtaaacgctgttggcgtcgatctcaacaccgcttctgttccgctgttaacccgcgtggcgggcctgacgcgcatgatggcgcaaaacatcgtggcctggcgcgatgagaacggtcagttccagaaccgtcagcaactgctgaaagtgagccgtctggggccgaaagccttcgagcagtgtgcgggcttcctgcgtattaaccacggcgataacccgctggacgcctctaccgttcacccggaagcctatccggtggtggaacgcattctggcagcaacacagcaggcactgaaagatctgatgggtaacagcagcgagctgcgtaacctgaaagcgtctgactttactgatgagaaattcggtgtgccgacagtaactgacatcatcaaagagctggaaaaaccgggtcgcgatccgcgtccggaatttaaaaccgctcagtttgctgatggcgtcgagacaatgaacgacctgcaaccgggtatgatcctcgaaggcgcggtgaccaacgtcaccaactttggcgcgtttgtcgatatcggcgtgcatcaggacggcctggttcacatctcttcattgtcgaataagtttgtggaagatccgcataccgtggtgaaagcgggcgacattgtgaaggtgaaagtgctggaagtggatcttcagcgtaaacgtatcgccctgaccatgcgtctggacgagcagcctggcgaaaccaacgcccgtcgcggcggcggtaatgaacgcccgcaaaacaaccgcccggcagccaaaccgcgtgggcgtgaagcgcagcctgccggtaacagcgcgatgatggatgcgctggcggcggcaatgggcaaaaaacgttaaacgccctggctggcctacggttcaaatttgcacgaaatcgtagggcagataaagcgttcacgccgcatctggcaacgaacgccttgcctgacataaaagtgccggagaatatctccggcctttttattccacagccaaactcacaatatatttcgttaatatttatcacttcattaacaactgaaaccttaattaaacattaaccagtcctggtaattcgctattcgaattatattttcgctgcgatataaccttgagccacatcaacattgagtcagattattattcaaaccaacattcgcacacattttaagtattgctgatagaaaccattctcattatcattgtgttgttgattatttaatctctcctttgttggcaaatcatctggtctcatgtcgctgtcaaacgccccatgaggtagttatccagttaatgagaaacaagtaggcacctatgcaatacactccagatactgcgtggaaaatcactggcttttcccgtgaaatcagcccggcatatcgccaaaaactgctttctcttggcatgttacctggctcctcttttaatgtggtgcgcgtcgctccactcggcgaccccattcatatcgaaacccgtcgtgtgagcctggtattacgcaaaaaagatctggccttattagaagtggaagcggtttcctgttaatacggtgataacaacaatgaaaaaattaaccattggcttaattggtaatccaaattctggcaagacaaccttatttaaccagctcactggcgcacgtcagcgtgtaggtaactgggctggcgttaccgtcgaacgtaaagaagggcaattctccaccaccgatcatcaggtcacgctggtggacctgcccggcacctattctctgaccaccatctcatcgcagacctcgctcgatgagcaaatcgcctgtcactacatcttgagtggcgacgccgacctgctgattaacgtggtggatgcgtctaaccttgagcgtaacctgtacctgacgctacaactgctggaactcggcattccctgcatcgtggcgctgaacatgctcgacattgccgagaagcaaaatattcgcattgaaattgatgctctgtcggcgcgtcttggctgcccggtaatcccgctggtttcaacccgtggtcgcggtattgaagcgctcaagctggcaattgatcgctataaagctaacgagaatgtggaactggtgcattacgcacagccgctgctcaacgaagcagattcactggcaaaagtgatgccttccgacatcccgctgaaacaacgtcgctggctgggcctgcaaatgctggaaggcgatatctacagccgcgcctacgccggtgaagcgtcgcagcatcttgatgccgccctcgcccgtctgcgtaatgagatggacgatccggcgctgcacattgccgatgcgcgttaccagtgcattgctgccatctgtgatgtggtaagcaacaccctgacggcagaacccagccgtttcaccactgcggtagataaaatcgtgctcaaccgtttcctcggtctgccgattttcctctttgtgatgtacctgatgttcctgctggctatcaacatcggcggggcgttacagccgctgtttgacgtcggctccgtggcgctatttgtgcatggtattcagtggattggctacacgctccacttcccggactggctgactatcttcctcgcccagggcctgggtggcggtattaacaccgtgctgccactggtgccgcagatcggcatgatgtacctgttcctctccttcctcgaggactccggctatatggcgcgtgcggcgtttgtgatggaccgtctgatgcaggcgctgggcttgccggggaaatcctttgtaccgctaatcgtgggtttcggttgtaacgtaccgtcggtaatgggcgcacgtacgcttgatgcaccgcgtgaacgtctgatgaccatcatgatggcaccgtttatgtcctgcggcgcgcgtctggctatcttcgcagtattcgcggctgctttcttcgggcagaacggtgcgctggcggtcttctcgctgtatatgctcggtattgtgatggcggtgctgactggcctgatgctcaagtacaccatcatgcgcggtgaagcgacgccgtttgtcatggagctgccggtctaccatgtaccacacgttaaaagcctgattatccagacctggcagcgtctgaaaggcttcgttctgcgtgctggtaaagtgattatcatcgtcagcattttcctgagtgctttcaacagcttctctctgagcgggaaaatcgtcgataacatcaacgactcggcgctggcttccgtcagccgggtgatcaccccagtcttcaagccgattggcgtgcatgaagataactggcaggcaacggttggtctgtttacaggcgcaatggcgaaagaagtggtggtgggtacgctcaacaccctctacaccgcagaaaatattcaggacgaagagttcaatccggcggaatttaacctcggtgaagagcttttcagcgcggtagatgaaacctggcagagcctgaaagacaccttcagccttagcgtactgatgaacccgattgaagcgagcaaaggcgacggcgaaatgggtaccggggcgatgggtgtgatggatcagaaattcggtagcgcagctgccgcatacagctacctgattttcgtcctgctgtacgtaccgtgcatctcggtgatgggtgctatcgcccgtgaatcaagccgtggctggatgggcttctccatcttgtgggggctaaatatcgcttactcgctggcaacattgttctatcaagtcgccagctacagccagcatccaacttacagcctggtgtgcattctggcggttatcctgtttaacatcgtggttatcggtctgctgcgccgcgcgcgtagccgggtgaatatcgaactgctggcaacgcgcaaatcggtaagcagttgctgcgcagccagcaccaccggtgattgccattaatggcttcacttattcaggtacgtgatttgctggcgttacggggccgtatggaagcggcccagataagccaggcattgaatacgccgcagccaatgattaacgccatgctgcaacagctggaaagcatgggcaaagccgtgcggattcaggaagaacctgacggctgcctctctggcagttgtaaaagctgcccggaaggcaaagcctgcctgcgcgagtggtgggcgctgcgttaaccttactccatcgcctgttttgaaaagcccggtatgcgtttgcatccgggctttttgcgtgcggctttccataaaaatgcaacccttgcaacgcgacgtaaattcctctgaaagcgtctcgcagggatgaaaactcgctaatgcacaggtgtggagtggcgcgtagagtcgcggcattcaaacaacaggtgaaggaacgccatgagcaaaaagcagagttccaccccacacgatgcgctgttcaaactctttttacgccaaccggagacggcgcgcgattttcttgcgttccatttaccggcacctattcacgcgctctgtgatatgaaaaccctcaagctggagtcgagtagctttattgatgacgatctgcgtgaaagctattccgacgtgctgtggtcggtgaaaacggaacaaggaccaggatacatctattgtctgattgaacatcaaagcacctcaaacaaactgatcgcatttcgcatgatgcgctacgccattgccgcaatgcaaaatcacctggatgccggatacaaaacattgccgatggtggtgccgttgttgttttaccacggtattgaaagcccctatccctattcgctgtgttggcttgattgtttcgccgatcccaacctggcaaggcagctttatgcctctgcatttccgctgattgatgtcaccgtcatgcctgatgatgaaatcatgcagcaccgacgtatggcgctgctggagttaattcaaaaacatattcgtcaacgcgacctgatggggctggtagagcaaatggcctgcttattaagtagtggatacgctaatgacagacaaatcaaagggctgtttaattacatactgcaaactggcgatgcggtacgttttaacgattttatcgacggtgtgaccgaacgttcaccgaaacacaaggagagtttaatgactattgcggaaagattgcggcaggaagggtttcagaaaggtatacgtaccaacgccctaaatattgccaaaaccatgctggatgccggagtctctcttgaggacgttctgcgatttaccagcctgacggttgaagaccttgctgaaataaatcatcaataacgtaaaggatggttttaatgacagatgcagaaagagaatatcttattagttacctgattggttatttattggatcgacgcctggaagccctggatatcgccaaaagaatgctgtaatccggagtccctcttgcagacatcatgcgttttaccggggtgtcagaagaagagttggctgcggcgagtcagtaaagttctgtctcgccatttcaaaagccacctacaccctctgcttcaacgccaccagcatgcgacaaaactcggccggatgcgaaataaacggcgcatgggccgctttggcgaagatgtatgattcgctgtgaggccaaagtttatccagcatcggcaccactttgcgcggcaccagaccatcgagatagccatacaatcgcaaaaacggcatggacacgttttgcagcggctgacggagatcgaccgttttcaggatttccagcccgccattaagcacgtcaacctccggcatcggtaacgccagaacggttttcttcaacgcccgcgcatcctggcgcgccgtttcagtacccatggtttgtaacgcaaggaaccgttccactgtacgctgaaaatcatcactgagttgctgctgaaatcccgccagcacgtccggttttatccccggccactcgtcacgagcactaaaacaaggcgacgacgccacggtgaccagtgcctgaacacgctcgggatgggttaacgcaatctggcttgccaccagcccacccagactccagcctaaccaaatggctttatcaggtgcctgtcgcagcacggcttcggccatatcagcaagcgacagcgcaccaaatccccggctgcgcccgaaaccgggcagatcaacaaggtgcagcgtaaaatgcgagctaagttcctcgtcaatgcaacgccacacttcggcattcagtccccatccgtgcaacagcacaagatgaacattcccctgacctttggtctgccaccagatgttattcatccgctattgttctcttttgacttacaaggatgaacatatgctaacagtaccgggattatgctggctatgccgaatgccgctggcgttaggtcattgggggatttgttcggtctgttcacgcgccgcccgtacagataaaacgttatgcccacaatgtggattacccgccacacactcacatcttccctgcggtcgctgcctgcaaaaaccgccgccctggcaaagactggtcactgttgccgactatgcgccgccattaagtccgcttatccaccagcttaagttttcccggcgcagcgaaatcgccagcgccctggcacgtctgttactattggaagtcttacacgcccgtcgcaccaccggcttgcaactgcctgatcgcatcatcagcgttccgttatggcagcggcgtcactggcgtcggggatttaatcagagcgatttgctgtgtcagccgttatcacgctggttgcactgccaatgggatagcgaagccgtcacacgaacacgggccaccgctatccagcattttctcagtgcccggctgcgcaagcgcaacctgaaaaatgcctttcgccttgaattgcctgtgcaaggtcgccatatggtgattgtggatgatgtcgtcaccaccggaagtaccgtcgcagagattgcgcagttgcttttacgcaatggtgcggcgactgtccaggtctggtgcctttgtcgaaccttgtagagcctcgatgatgggcgtattataaccaactaaaatagtcaactattaggccattactatgatccgtatttccgatgctgcacaagcgcactttgccaaactgctggcaaatcaggaagaagggacacaaatccgcgtatttgtgattaaccctggcacgcctaacgctgaatgtggcgtttcttattgtccgccggacgctgtagaagccaccgacactgccctgaaatttgacctgctgaccgcgtatgttgatgagttaagcgctccttacctggaagatgcagagatcgattttgttaccgaccagttgggttctcagctaacactgaaagcgcctaacgccaaaatgcgtaaagtcgcagacgatgcaccgctgatggagcgcgttgagtatatgctgcagtcgcagatcaacccgcaactggctggtcacggtggtcgcgtttcgctgatggaaatcaccgaagacggttacgctattctgcaatttggcggcggctgtaacggttgttccatggtcgatgtgacgctgaaagaagggatcgagaagcagttgctgaacgaattcccggagctgaaaggtgtgcgcgatctcaccgaacaccagcgcggcgagcactcctactactaagttatcccctcttttgtagattgcccgatgcgacgctaaagcgtcatttcgggcctacgttgaacatgagccagacgttggcgcagcattgctttggcaaatccctcccttcgtttccccgcgataatatgaccaacctctcataatttaaatttaccccgctctggtgattctcaaacgccggatgttacccgtatcattcacgtgggtaccaaacatactcctgacatctgactacaataattagttttagtgggtatcagtcgtggtgccgcaatatctctgttcccgattgggataattagagtttgtcgtcagaaaattgacgttacccataacaaatgaaaggccaggtaaatcatgccattagtcattgttgctatcggtgtaatcttgttgttgctcctgatgatccgtttcaaaatgaacggcttcatcgctctcgtcctcgtggcgcttgctgttggattaatgcaaggaatgccgctggataaagttattggctccatcaaagccggtgtcggcggaacgctcggtagccttgccctgatcatgggttttggcgcaatgctgggcaaaatgctggcagactgcggtggcgcacaacgtatcgccaccacgctgattgctaaatttggtaaaaaacacatccagtgggcggtggtactgactggttttaccgttggttttgccctgttctatgaagtgggctttgtgctgatgctgccgctggtgtttaccatcgcggcttccgcgaatattccactgctgtatgttggtgtaccaatggcggctgcactgtctgtgacccacggcttcctgccaccgcatccgggtccgactgcgattgccaccattttcaatgccgatatgggtaaaaccctgctgtacggtactattctggcaatcccgaccgtgattctcgccggtccggtttacgctcgcgtgctgaaaggtatcgataagccgatcccggaaggtctgtacagcgcgaaaaccttcagcgaagaagagatgccgagctttggcgtcagcgtctggacctctctggtgccggtagtgctgatggcgatgcgtgcgattgccgaaatgatcctgccgaaaggtcacgctttcctgccggtagcggagttcctcggtgacccagtaatggctacgctgattgccgtactgattgcgatgttcacctttggtctgaaccgtggtcgttcaatggatcagattaacgacacgctggtttcttccatcaaaatcattgcgatgatgctgttgattatcggtggtggcggtgcgttcaagcaggtgctggtagacagcggcgtggacaaatacattgcttccatgatgcacgaaaccaacatttctccgctgctgatggcctggtcgattgctgccgtactgcgtatcgcgctgggttccgcaaccgttgcggcaatcactgcgggtggtatcgcggcaccgctgattgcaacgacgggtgttagcccggagctgatggttattgcggtgggttccggtagtgtgattttctctcacgtgaacgatccgggcttctggctgttcaaagagtactttaacctgactatcggcgagaccatcaaatcctggtcgatgctggaaaccattatctcggtgtgcggtctagtaggctgtctgctgctgaatatggtgatttgataacactgactgccggatgcatcgcatccggcatcaaccgcaccctactacttcttcgctgccgctctgcgccgtctgtccaaatccttcagcaacttgttcacgccatcatcggcaaacatcgcctcaagcgttgcggagagcttgcgccgccagtttttatactggtaactggtgccgggaatattcaccggttcagccatatccagccagtcttccggctgtagtcctaacagggcgctgttgctatcggcgatgtagcgctgtaagccacgattcagcgtcggcgtcatcgacatcaacgatgccttatgcccggcacgttttggcagacaaccatatttatgcagagcatccagtagtccttgcttcgccagttcgcgatcctgatacagaccgcgcagtatcacttcatccggatacaaccccagcgttttgcccagcgttagatccccgctctcccagtagccgcgtagcgtaggcaggtcgtgtgtcgccgcaaccgccatcgactgctctgggtacgctttcggtgagcggaatgtcttctcgtggtcgttttcgaaatagagcactttgtaggagtacacaccgctgctgcgcagcttaccgacaatctctaccggtacggtaccgagatcttcaccaatcaccatacagcgatgacgcttactttcgagtgccagaatcgagagcagatcatccaccggatagtgaacatatgccccctgatctgccgtctcgccatacggtatccaccacaaacgcagcatcgacatcacatggtcaattcgtaatgcgccgcagttttgcatattggcacgcaacagctcgataaacggttcataggcacgcgcggtgataatatgcgggtccattggcggcaatccccagttctgccccaacgggccgaggatatccggcggcgcgccaaccgacgctttcaggcaatacaactcccggtcgcaccaggtttctgctccaccctctgctacaccaacggccaggtcacgatacaagccaatcggcatttcatagccctggcttatctcccagcaggcggcaaactggctgtaagccagccactgcaaccagagataaaaatcaacgtcatcgcgatgttcttcgcagaactggcgcacttctggtgaatccacgttctgatacatctctggccatgcaggccagccccagcgcatttcgtcctctttcacttgctgggcatgtagtgcgtcaaacgccgcctgccagaacaggctgtcgccttgctctgcaacaaactggcgaaacgcggccatctgttcatcatcacgttgcgcgaaacctttccacgccattcgtaatgctgtcatttttagggcggtaaccgtggagtaatcgacccagtcggcatcccgcgcctgttgcagcgtctgttgcgtggtcggcaacttccaccaggcctgagcctcttcgctaagatggaaatcttcaacggcgttaacgtcgatataaatcacattcagccaacggcgagaagacgggctatacgggctggcactttccggatttgccggatagagcgcatgaatcgggttcagaccgatgaacgacccgccacgttttaccacatccaccagcatcgctttgagatcgccaaaatccccaataccccagtttttttccgatcgcagcgtataaagctgaacgcaggcaccccacagcttttgtttgttcagcaacgcctgcggttcgtaacagcgtttcggggcgacaatcacccggcaatgcgcgcgctggtcgtcctgggtgagtgtcagcgtgtgataaccttccggcagcttcgtcggtagattgaacgctttgccccccgttacatggcctttgtactgcgttccttcttcggtggtcagcagccagctatattcgccgctgccctccaccaccatcggcatttttttgccgctggtataaaccatgacattcgggactggcgttaccgccactttcgtggcggtacgttgatgcatcgcgtcaagcaaacgccgtttggtttcggcgctaatcgactgcggtttaccgtgggcattgatgtaattggggctaatccccgccgccagcgcggcattatccagacgtttgctttccatcgagcttccttagcgttttgcctgccagatacgagcctgataatcgcgaatagagcgatccgagctaaacataccgcagcgggcggtattgaggatcgccgcgcgagtccaggcctcctggtcgcggtacagcacatccacctgcttttgtgcctctacataggctgcgaaatccgccatcaccagatacggatcgccgccctgtttgccgatactgtgcagcatctggtcgaaggcatgcttatcgccgtcgctgtatttgccgctttccagctctttcaatactgcgtccagcaccttatctttcttccgccatttcaccgggtcgtagcctttggccagaattgccttcacttgttccacggtatgaccaaaaataaagatattttcttcaccaactttctcggcgatttcaacgttcgcaccatccagcgtaccgacagtaagcgcaccattgagcgccagtttcatattgccggtaccggaagcttctttacctgccgtcgaaatttgttcggagatatccgccgccgggatcagtttttccgccgccgaaacgcaataatccggcaggaacaccaccttcaacttgtcgccaaccagcggatcgttgttgatcacgtcagccactttgttgatcgcaaagataatattcttcgccaggtagtagcccggtgccgctttcgcgccgaagaggaagacgcgcggtacgcgatcagcctgcgggttttcacgaatttctttgtacaacgccagaatatgcagcagattcaggtgctggcgtttgtactcatgcagacgtttgatctgaatatcgaaaatcgcctgtggattgatctcaataccggtacgaactttcacaaactctgccagacggactttattcgcctgcttgatctcgcgatattgctgacggaatttcgcatcatcagcgaatttttccagattgatcagttgatcgagatcgttagcccactcttttttcagtgatttatccaacagagccgccagtgccgggttgcactgtttgatccagcgacgtggggtaataccgttggtgacgttatggaatttgttcggccatagctggtgatattccgggaacagatctttcaccaccagatccgagtgcagggccgcaacaccgtttaccgcgaaaccgccaaccacacacaggttcgccatatgcacttgtttgtcgtgtaccaccgccagtttggcccatactttttcatcgcccggccaggttttttccaccagcgttttaaagcgtgtattaatttcgttaataatctgcatgtggcgcggcagtaagcctttcaccagtttcacatcccagcgttccagcgcttctggcatcaaggtatggttggtgtaagcgaaagttttactggtgatggcccaggcatcatcccagctcatctggtgctcatcgatcagcacgcgcagcagttctggaatcgcgatagttgggtgggtatcgttcagctgaataacttcgtactccgccagctcgtgtagtttacgccccgccagatgatggcgacgcaaaatatccgctaccgagcaggcacactggaagtattgctgcatcaggcgcagctttttaccggcagtatggttgtcgtttggatagagaactttggtcagtttttccgcgttgatgccctgctgttcggcacgcaggaaatcaccatcgttaaatttagtcagatcaaacggatgcgcatgcgtcgcctgccacagacgcagtggctgcgccacgccattacgatagccgacaacggggagatcccacgcttgaccagtaatggtaaattccggctcccagcgtccgtctttcgtcactttaccgccaattccaacctgcacatccagtgcttcattgtggcggaaccacggatagttaccacgatgccagtcatccggcgcttcaacctgtttgccatcgacaaatgactggcggaacaagccatattgataattaaggccgtaaccagtagctgactgcccgacggtcgccattgagtcgaggaagcatgccgccagacgtcccagaccaccgttacccagcgccgggtcgatctcttcttccagcaagtcagtcaggttgatgtcataagccttcaacgaatcctgtacatcctgataccagccgagattcaacaggttgttgcccgtcaggcgaccaatcaaaaactccattgagatgtagttaacatgtcgctgattcgccaccggtttggcaaatggctgagcacgcagcatttcggccagtgcttcgctcactgccagccaccactgacgaggggtcatttcagccgcagaatttaagccataacgctgccactgacgtgaaagcgcttcctgaaattgcttatcgttaaaaataggttgtgacataggagttccacttttcttagattttcaacacaacgttatcgctagtttgccaggctcgatgttgaccttcctcatcctgcgggggattaggcagggaggagttgcggggatgagcaaggaaatgtgatctcgaccacttaaagctagtgcaaaccacaggattagcagcaaatcaatgccatacagcgcagaaaatctgtatctaagtgcaaaaaatggccgttgcgtattttcaaaaagcggaaggtaactctataaattaagtaaaggagtgaaacagtttcataagtaaaatatcaagtgtgctccatctcattcttaatagatttattaagatcatctttttagatggcactttcatcagggataaagaaaaaacccttgcttaaatgaaactgatgaacataagggaaataccgtacaacccagcattcacgctgtatcagcgtcgttttaggtgagtcattaataaagatttggaattgtgacagagtgcaaattcagacacataaaaaaacgtcatcgcttgcattagaaaggtttctggccgaccttataaccattaattacgaagcgcaaaaaaaataatatttcctcattttccacagtgaagtgattaactatgctgattccgtcaaaattaagtcgtccggttcgactcgaccataccgtggttcgtgagcgcctgctggctaaactttccggcgcgaacaacttccggctggcgctgatcacaagtcctgcgggctacggaaagaccacgctcatttcccagtgggcggcaggcaaaaacgatatcggctggtactcgctggatgaaggtgataaccagcaagagcgtttcgccagctatctcattgccgccgtgcagcaggcaaccaacggtcactgtgcgatatgtgagacgatggcgcaaaaacggcaatatgccagtctgacgtcactcttcgcccagcttttcattgagctggcggaatggcatagcccactttatctggtcatcgatgactatcatctgatcactaatccagtgatccacgagtcaatgcgcttctttattcgccatcaaccagaaaatctcaccctggtggtgttgtcacgcaaccttccgcaactgggcattgccaatctgcgtgttcgtgatcaactgctggaaattggcagtcagcaactggcatttacccatcaggaagcgaagcagttttttgattgccgtctgtcatcgccgattgaagccgcagaaagcagtcggatttgtgatgacgtttccggttgggcgacggcactgcagctaatcgccctctccgcccggcagaatacccactcagcccataagtcggcacgccgcctggcgggaatcaatgccagccatctttcggattatctggtcgatgaggttttggataacgtcgatctcgcaacgcgccattttctgttgaaaagcgccattttgcgctcaatgaacgatgcactcatcacccgtgtgaccggcgaagaaaacgggcaaatgcgcctcgaagagattgagcgtcaggggctgtttttacagcggatggatgataccggcgagtggttctgctatcacccgctgtttggtaacttcctgcgccagcgctgccagtgggaactggcggcggagctgccggaaatccaccgtgccgccgcagaaagctggatggcccagggatttcccagcgaagcgattcatcatgcgttggcggcaggcgatgcgctgatgctgcgcgatattctgcttaatcacgcctggagtctgttcaaccatagcgaactgtcgctgctggaagagtcgcttaaggccctgccgtgggacagtttgctggaaaatccgcagttagtgttattgcaggcgtggctgatgcaaagccaacatcgctacggcgaagttaacaccctgctagcccgtgctgaacatgaaatcaaggacatcagagaaggcaccatgcacgcagaatttaacgctctgcgcgcccaggtagcgattaacgatggtaatccggatgaagcggaacggctggcaaaactggcactggaagaactgcctccgggctggttctatagccgcattgtagcaacctcagtgctgggtgaagtattgcactgcaaaggcgaattgacccgctcactggcgttaatgcagcaaaccgaacagatggcgcgccagcacgatgtctggcactacgccttatggagtttaatccagcaaagtgaaattctgtttgcccaagggttcctgcaaaccgcgtgggaaacgcaggaaaaagcgttccagctgatcaacgagcagcatctggaacagctgccaatgcatgagtttctggtgcgcattcgtgcgcagctgttatgggcctgggcgcggctggatgaagccgaagcgtcggcgcgtagcgggattgaagtcttgtcgtcttatcagccacagcaacagcttcagtgcctggcaatgttgattcaatgctcgctggcccgtggtgatttagataacgcccgtagccagctgaaccgtctggaaaacctgctgggaaatggcaaatatcacagcgactggatctctaacgccaacaaagtccgggtgatttactggcaaatgaccggcgataaagccgccgctgccaactggttgcgtcatacggctaaaccagagtttgcgaacaaccacttcctgcaaggtcaatggcgcaacattgcccgtgcacaaatcttgctgggcgagtttgaaccggcagaaattgttctcgaagaactcaatgaaaacgcccgcagtctgcggttgatgagcgatctcaaccgtaacctgttgctgcttaatcaactgtactggcaggccggacgtaaaagtgacgcccagcgtgtgttgctggacgcattaaaactggcgaatcgcaccggatttatcagtcattttgtcatcgaaggcgaagcgatggcgcaacaactgcgccagctgattcaactcaatacgctgccggaactggaacagcatcgtgcgcagcgtattctgcgagaaatcaatcaacatcatcggcataaattcgcccatttcgatgagaatttcgttgaacgtctgctaaatcatccggaagtgccagaactgatccgcaccagcccgctgacccaacgtgaatggcaggtcctggggctgatttactccggttacagcaacgaacaaattgcaggcgaactggaagtggcggcaaccaccatcaagacgcatatccgcaatctgtaccaaaaactcggcgtcgcccaccgtcaggctgccgtgcagcacgcgcaaaaactgctgaagatgatgggatatggagtgtgagtttagccggataatacgtcggatccggcttacatctttatatcattcaatgctcacccgcgttacgccatccgcctccaccagactaaaccgcactggcaagaaacgctccaccaccgcaatattggtcagcagatggcatgagggatgggcgaccgtaaattctcccgcgcccgccagcgccatcggcagtaccagctggtcggcgagatattcccccaccgccgccgggcttgccaggtagcgtttcacctctttcaccaactgtgccgcgaccacttcggcactgatgcgcttttcaccgacgacaaaaaagcgttcggtgatattttcactttcgacttcaagcgagacggtattacccggcccctggtcacgcggcaggttatgaatattctgctcatgcagggaaaaactacccgccagcgtagcgatttcacgctcagcaacatgcctcggcacgccagctaatagcacctctccacgcatctgcacaatgttcccgcgctcgccaagttgcaaggtgttaaacaatgccacgggcgagacttccgttgccaccaccccgcctccagcaggataaaaaccgtggcgtaataatgtggtttgctgatgaatgcccattttcgccagcagcggctccagcacccggcggataaaatccgcaggcggtgccgacgggttatcggtgccgccgctcacttcaacacgcgaaggcccatcagcaaaccacagcgcgggtagcaccgtttgcagcaccagcgtgctgcttccggcgcttccgatagcaaagcggtaatcgccgccgcgcacggtgccgggccggaagatcagacgctgcgccctcagctccgcgccttccaccgttgctcggcaaatttccgtcgccgccttaaccgcggtcagatgctggcgcaacagccccggtttcgcccgcccggcacgaatgtcagtgatggtaaatggctggccagttatcatcgacaggctcagcgccgagcgcaggatctgcccgccgccttcgccctgtgcgccatccagcgcaatcatccttttcatcatttatccttttacgcacaccacctgacgcagggtatagataacttccaccagatcgctttgtgccgccatcaccgcatcaatatctttatacgccatcgggatttcgtcgatcacttcggcatctttacggcattccacatgcgcggtggcacgaatttgatcttccacgctgaacatttttttcgctttagtacggctcataacccgcccggcaccgtggctgcacgaacagaacgactcttcatttcccagcccacggacgataaagctcttcgcccccatcgaaccgggaataattccatattgaccagcacgcgcagacaccgcgcctttacgcgtcacgtagatctcttcaccaaagtgctgttctttttgcacatagttgtggtgacagttgatctcttccatcgccagcgtttgtggctgtctgaccgttttctgcgtaatgctctgcaacgccgttaccacgttttccatcatcgcatcgcggttaaggctggcaaaaagctgcgcccaggccacggctttcaggtaatcatcaaagtattccgtaccttccataaagtacgccagatcacgcgacggcaatgtttcaagcgtttcctgcatctctttttgcgccagatcgataaagtaagttccgatggcattaccgattccgcgtgaaccggagtgcagcataatccacacctgatccgactcatcaaggcagatttcaataaagtggttacccgttcccagcgttcccaggtgtttatagttgttagtgttaaggaaacggggatatttttgcgttaaccactgataaccggcttcaagctcagcccatttcgcatcgacgttaacaggcgggttttcccatgcgcctttatcacgtttacaacgcccggtagtacgcccgtgcggcacggcagtttcaattgcctgacgcagctccgccaggttttccggcaggtctgccgccgttaacgcggtacgcagcgcgttcattccacaaccgatatccacgcccaccgccgccggaataatcgcccctttggttgggatcacgctaccaatggtggaacctttacccaggtgtacatcaggcattaccgcaatatgtttgaaaataaacggcatcttcgccgtattaataagttgctgacgcgcatcggcctctaccggcacgcctttggtccacatttttaccggggcattttcagtggtcagtaattcgtaattcattttgtttttctcttttcgttgtttgctgtcctgataattgcaaccgtcgtgccagaaaattaaataagcagcttaattttttaatttattgtttttaatagattaaatctttacgtccgtaaacggagatttcccgcaaagccaatttaccgataatgaaatatcgtcttttataaggatatctagagatgcgtaaaacagtggcttttggttttgtcggaacggtgctggattatgccgggcgcggcagtcagcgctggtcgaaatggcgtccgacgctttgtttatgccagcaagaatcgttggtcatcgatcgactggaattattgcatgacgcccgctcgcgctcgctatttgaaacgcttaaacgcgatatcgccagcgtttcgccagaaacagaagtggtgggcgttgagatagaactgcataacccgtgggatttcgaagaggtctacgcctgcctgcatgatttcgcccgtggttacgcgttccagccagaaaaagaagactatttaattcacatcaccaccggtacccacgtcgcgcagatttgctggtttctgctggcagaagcgcgttatctacccgcccggttgatacaatcttcaccaccgcgcaaaaaagaacaaccgcgcggcgcaggtgaagtgacgattatcgatctcgatttaagccgttataacgccatcgccagccgctttgccgaggaacgccagcaaaccctcgatttcctcaaatccggcattgccacgcgtaacccccacttcaaccgcatgattgagcagatcgaaaaagtggcgattaaatcccgcgcaccgatcctgctcaacggcccgaccggggcgggtaagtcatttctggcgcgacgcatctttgaattgaaacaggcgcggcatcagtttagcggcgcgtttgtggaagtgaactgcgccaccctgcgtggcgataccgccatgtcgacgctgtttggtcatgtgaaaggcgcgtttaccggggcgcgggagtcgcgggaaggattattacgcagcgccaacggcgggatgttatttcttgatgagattggcgaactgggcgcagacgaacaggcgatgttgctgaaagccattgaagagaaaaccttttacccatttggcagcgatcgccaggtgagcagtgattttcagctgatcgccggaacggtgcgcgatttgcgccagctggttgccgaaggcaaatttcgcgaagacctgtacgcacgcattaatctctggaccttcaccctgccggggctgcgccagcgccaggaagatatcgaaccgaacctggattatgaagtggagcgccacgccgcgcttactggcgacagcgtgcgttttaacaccgaagcacggcgcgcctggctggcttttgcgacatctccccaggcaacatggcgcggtaactttcgagaactttctgccagcgtcacgcggatggcaacctttgccgatagcgggcgcattactctggaaaccgtagaagatgagataaaccgtctgcgctataactggcaggagagtcgcccctccgcgcttccggcgttgctgggcgctgaggcagaaaacatcgacctctttgatcgactgcaactggaacacgtaatagccatctgccgccaggcaaagtcactttctgctgccggacgccagctttttgacgtttcgcgccagggcaaagccagcgtcaatgacgcggatcggctacgcaaatacctggcgcgttttggtctgacgtgggaagccgtgcaggatcagcacagctccagttgaatatgatggtccgtcagcacctgcatcacgcttactggcggcggggcgtcggtgtagacggcatctaccatgctgatactgcccatattgaccatcgcgttacggccaaatttcgagtgatcgacaaccagcataacgtggcgcgagttctcaataatggcgcgtttggtgcgaacttcgtggtaatcgaactccagcagcgagccgtcgctatcgatgccactaatccccagaatgccgaaatcaaggcggaactgggagataaaatcgagcgtcgcttcgcctatgatcccaccatcgcggctacgtaattcgccaccggcgagaataatgcgaaaatcttcttttaccatcaacgtgttagcgacgttgagattgttggtgacaatgcgcaaattgctgtgattaagcagcgcgtgcgccaccgcttccggggtggtgccgatatcgataaacagcgtcgagccgttggggatttgctccgccactttgcgggcaatacgctctttttcttcggtctgggtggctttgcgatcgtgccacggcgtgttaaccgaactggaaggtagcgccgcgccgccatgatggcgcaggatcaggttttgctccgccagctcattgaggtcgcgacgaatagtctgcgggctgacggagaagtgctccaccagttcctcggtactgacataaccctgctgtttaaccagttcgataataccgttgtgacgttgtgtttgtttcatttataaatccctggaattattttcgttttcgcgcattgagcgaatcaacaaaagccatcgctaaacccacggctaacccggcgatgtgtgctccgttcgccatcgacatcccaaacaaatcaaaccatccggcgacaatccagatcagcgcaaagataattaacccacgttgcaggtaaatgccactttgcggatcgcgttcgccacgtagccagacgtagcccatcagcgcatacaccacgccagaaagcccgccaaaccacggcccgctgaatttttgctgcacatagccgcttaacagggcgctaatgagagtaatgacaattagcttaccgctaccgaggcgtttttccaccgcaccgccgagataccaccaccagagcaggttaaagaggatatgcatcagcgagaagtgcattaacgcgtgggtgaagtaacgccagaactcaaatttcagtgtcggatcgaatggccaggccagccataacatcacttcctgatcgccgagaatttgcatggcaataaacaccaccacgcaggcgatcatcatcacccaggttaccgggcctgcgcgttcacgcaaggcagcaaagaaaggataacggcgataatgcaggccactgccggtatggcccgcctgccagctggccgccagataacgcggatctgccgggttttcgagaaaacgcgccagctccgcccgcacgcgctcggcctgggactcatccgccagccagacatcgctttggttatgttgttgaatcgtgaggataacaccctgcgtcgccatgtaatcaacaaacgcctgcgccacgcgggggttagcaaaagaggtaatcatcaacatcgttgctgtcgcttattccacacaaaaggggacagtataaagcgttacgcgccgtacgccacctctgcgggaaactgacgctgccaggcttcaaagccgccgtcaatgctatagaccacatcgtagccctgttgcagcagatactgcgccgcacctttgctgctattgccgtggtaacacatcaccatcaccggtgtgtcaaagtcgttatcacgcataaacgcgcccagtgtgtcgttggttaaatggaaagcctgcaccgcatgccccattgcgaaactctgtggatcgcgaatatcgaccagcaccgcctctttttcctgcaacttctggtgcgcgtcggcaacgttaatacattcgaactgatccatgcgtctctctttctttacaaacaagtgggcaaatttaccgcacagtttacgtcgaagcggcagataaacgccataatgttatacatatcactctaaaatgttttttcaatgttacctaaagcgcgattctttgctaatatgttcgataacgaacatttatgagctttaacgaaagtgaatgagggcagcatggaaaccaaagatctgattgtgataggtggcggcatcaatggtgctggtatcgcggcagacgccgctggacgcggtttatccgtgctgatgctggaggcgcaggatctcgcttgcgcgacctcctccgccagttcaaaactcattcacggtggcctacgctaccttgagcactatgaattccgcctggtcagcgaggcgctggctgaacgtgaagtgctgctgaaaatggccccgcatatcgccttcccgatgcgttttcgcctgccgcatcgtccgcatctgcgcccggcgtggatgattcgcattggtctgtttatgtacgatcatctgggtaaacgcaccagcctgccgggatcaaccggtttgcgttttggcgcaaattcagtgttaaaaccggaaattaagcgcggattcgaatattccgactgttgggtagacgacgcccgtctggtactcgccaacgcccagatggtggtgcgtaaaggcggagaagtgcttactcgtactcgtgctacttctgctcgccgcgaaaacggcctgtggattgtggaagcggaagatatcgataccggcaaaaaatatagctggcaagcgcgcggcctggttaacgccaccggcccgtgggtaaagcagttcttcgacgacgggatgcatctgccttcgccttatggcattcgcctgatcaaaggcagccatattgtggtgccacgcgtgcatacccagaagcaagcctacattctgcaaaacgaagataaacgtattgtgttcgtgatcccgtggatggacgagttttccatcatcggcaccaccgatgtggaatacaaaggcgatccgaaagcggtgaagattgaagagagtgaaatcaattacctgctgaaagtgtataacgtgcactttaaaaaacagcttagccgtgacgatatcgtctggacctattccggtgtgcgtccgctgtgtgatgatgagtccgactcgccgcaggctattacccgtgattacactcttgatatccatgatgaaaacggcaaagcaccgctgctgtcggtattcggcggtaagctgaccacctaccgcaaactggctgagcacgctctggaaaaactgacgccgtattatcagggtattggcccggcgtggacgaaagagagcgtgctgccgggaggtgccattgaaggcgaccgcgacgattacgccgctcgcctgcgccgccgttacccgttcctgactgaatcgctggcacgtcactacgcgcgcacttacggcagcaacagcgaactgctgctcggcaatgcgggagcgataagcgacctcggggaagatttcggtcatgagttctacgaagcggaactgaaatatctggtcgaccacgaatgggtccgccgcgccgacgatgccctgtggcgtcgcacaaaacaaggcatgtggctgaatgcggatcaacaatctcgtgtgagtcagtggctggtggagtatacgcagcagaagttgtcgctggcgtcgtaaattaacgtaaggtggccaggtcagatttcaatctgacctgagactgatgataaacaaaaaaactgcctgatgcgctacgcttatcaggcctacgtggtttatgcaatatattgaatttgcatgattttgtagaccaataagacgttcacgtcgcatccggcatggacaaagcgcatatacaaccgataaccaaagttgtaattccagaagtgaaatacgcctgatcatgagcgggatagagaacagtatctccccagaaaactcagcgtaataatacaagcagccagcgcaaccaccgtcggccatatcaagaacggtacaataataaagccgagaaataccacacctagcagcaaaacaccgtgaatttgttcatcgcgctaattcctttccctcgagggttatttcattgtgggatacatcggcacataacccatattttccatcaaactttaccctaccgatggctaaaaacgggctaatccgattctgcactgactcacacatcactggtattccacccgcaaaacagccagggcattataacgacccgcagcagggcgtcgccctgtggtacttacagggagagacagaaaagtcacatctgccgtctgagctgactcagcccggttttcaactaacttaaatggcacaccaacatgcgcagcaagagcgttcaagtctacggattcctgttggctatccataatcataatgccaacgtcggggttatcctccgcctgaataatgctttgccgaccattaacatctctcgttgatgaaatattgccatcaaaaaccagcgtcattacggcatcaatatctttgttcgtacagtttatcggaatagtggttgccactggagaaacgcccgtgggcttcactccagcaccagcccgacttaattcgctggcccagacatccggcatattaacggtaaaactagttccctcattaattgtgcaaccttgtggaacttcaatatttaagttgccaatataagcattaaatactggaattggtccgtgctctgttggaaactggctgacatacaaagaaaccagcaatacgttatttattgatatatcggatattatttttttatcaagtctgatttttatataaccttctgttcctgaggcccaacttgatggtttacttctgtctgctggataattggtgctatagttgtcaaaaggtactgccttatctgtcattgtgccatttttattatagagctttacatgtgtcgagacagatatttcatgagtcaaaggaataaatatatcgctcccctgatgatcaccagacgctcctgacggatcaatcccagaaacaccagaaaaataaacctcataatcatccagagaattacaataagccttataatgccctattttccagtcctgcgagggtaatactgtcccaggcgaattattattaacatctgagacaattaccgtaccaaaattataagaaaatgtcgcaggagtagtattattacctggtgcaccaggataacaaaaggcgcgatcccgtcccatatcttcagcatatactatgttatagcagctactgactaaaagaacaaacaatatacaaatcgcttttatatttccccaaaaataagtaagcatcatgcttctccagttatccatgtatcgctactgcacccataatagcattattttgtaaaacatttaattttacgctccatacgggtaaggcattattgtaaagatctagtgtttgccagttaatctcacaatatccttgccgctgacaccaatcctgttggcgatgactaaatggtgcaaccatgccaccatttatgcttttaccatcaatagataaattatagagtgtcacataccagggcgtagggttaaaaacggtgacagcttcattgtttcgcgaccagcgtaactgttgataagcgtcaagtggattacctgataacgtctctgggcggtaaaatattttcatcctattacgtacagccacctggagttgattttcattcttaagctgtgagttttgttcctgagcaggtaacactgcaatattcagtataaataaactctcacgatctataggtaactgcccccccacgcgattgattcttattttggtatttttatcttgtttaagtaccaataatggtggtgtggcaataaacgccttatctggaagtaaaggctgggattccagtgtcccttttaactgacgtccatcatcaggtgtcacggaaattttaaccagcatatctttactggcagtatttttaagctcgaccgaaattgatgactgcttttctgggtaaacaaaacgagtaccgccaacaacaactcctgcctgcgcatttgtgcaacatattaaaatgcatatcagcacgttaatcataagtgacgataaaggaaactgatgcattcgcatctcctggttgtacatcattttttatagctttataagcagcaaagaaatgcaatgtattatctaccaatggtgtaagggcataacttgtactctttataccattactaatactttgtctgttgttatcaaaaatagccagtgctaacccatcgactgagccctcttccagtttatatagggctgcgtcttcactaactggtattccatcaaacgtgacattggcatgactgacatcactgccacaacgggttaactttacagagaaaccaattttttcagtaacactccctgaatttctcaccatatagctgggaacatcaggcatgttaactgtgaaatttttagattcatcggcaacaatacaagtctttgccgttatgattccttctatacgtacaacacctgtatgtgttgtatcatcagcaatggatgacatagatatcacagagaataatagggcaattaaattccaatatcgtgtcatattaacctcactgatagtctatatcaaagtacaatagtgcgttcgcctgtcccgcatgtacgttttgctgagttgacttatagcggagtttaaaggttaaactggcatcgccattattatttaaaattaactctttgaatcctgattcactattaattgctataattttatcattactgtctaaaatttcgatgcccactccagttgcactatccgcgctggaagtaaggcgtaataaagtggtatttatagcatcagcatccccggtaaactgcacattagcacttactcctgaactataaacagtactggttgttgtaggacatccttccagattgatcgtaaatgtatggctgccagaaacatcccctacattcaaaaaatcattgacgtcataagttcccatgtttactggctggtctttacttccagttgtaatatcacacgttttcgctaataattgtcctgtaaatgtgaccactacagtatcgttagccagtgcgttatatgaaatcaccatcatgaacaatgatctaaacattaatagaataaatttttgtaatatattcattagcggcactccagatttgcatagctaatggcattatccaactcactttccggtaattgatagtttgcccgacattgctgataagaactttctccccactgtatatttattatgccttgtaaaggcaaaccggagagataaacctgtccactgtcacccactattcctgtaatctgagttgtcccctcagtgggtacactgaccgtcgcaccaaatggaactggtttattacgatagtgaacattaaataaacctcgaataccgacatgtgcattaaactcagcacgaactaaagcacctttgctgggtatcacttccatagtagtagcatctaattctgtatgcatactcatagacatagggtctaaagagatattattacgccgatattccgtggcataaggtacgacagcatagccacgccagtctgttttaacccccgttccgcgttccacatttacattgtttgccccaggtgcttttatcagtatatttgtttctcctaacggctggcttaacgtgagaccattttcgtgaataaccagggcaccacttaaaccatagttaaattgctggttaccattattatcgtagctgtatccagaatttagtgaaccatatgtaccacggtaatttatccctaccgagccattttcgccattattctggttggcaaaattttgttgaatattatagttgagattatgttgttccatcagcgatccagatactccggcatactgatttacatgaccgctattatcctgactataaccataagttgctgtcatagaatttgtcgcagtacgcccatcgacagctagtgataaccaattgctgatcggcaatgagacatttacggataagattctgtccgcatctgaacctggtgacttactataattataagcaatatttaaataaatcccatgtacactcgtattatagccgacctgatacaaggtatctttattattcgtattccagtaagtttgttgacttgccgccaaatacatagagccatattcgcccaatggttgcgatatatttgcctgaaactttcctcttttgttataacgtaaattataaaaatcattccagttataaacatagtctttttcattaagggtatctggatcgataaccgtacccgacatttgtttgtatgtggtatcactcaacgaataaaatccctccgtcgaatagcgataaccaataatctgaaaagccgtacctgtctgcactaacgattttgaatataggaaacggtacgattgcccttgatgtttactgccatcggcaagcgtgctattggcttgcgttaaatcaaatgacgtcgcaccaaacataccaaggttgaacccaagcccgagtgctattgcccgataattatttgagtattgcatccctccgtaggcggtaatatcccagggtaacccccaaatcaaatctccttgaaagacattcggactgttttgattatagctattgctacgatatttaccggcagttgccgaatatttaatatgcccttcgcgttgaagaatgggaacagcggcgtaaggaatggtatagatagtttcggaattatcagactctttgatcgtaacttccaaatccccagcggaagacgtagggttcagatcgttgatttcaaagggtcccggtggagtatatgtctgataaataacatagccattttgtttgatcgttacctgagcattgcttttagcaataccgcgcacagtgggggcaaaaccactttggctatcgggtagcatgttttcatcggattcaagtttagcaccacgaatactcacactgtcgaaaacatccgatgaagaccaggtatcacctagtgttaattcacttttaaaaggaataattactcgttgtaacgtactactcacatgtgcaattttacccggtgaattacctgaacgactccatgtagaataatcgcgaaaacgccacgcccctaaatttaaacctgaacggagatttaaataataactatcagacgcatagtctccacgatcactgttgccagaaaaatcataattaataagaatggccgggataccattatcccattcctcaggtggaatataaccacgggcttcatgctttaatattgcctgcggaaaggtcagtttgagtcgttgcgcatccagttcaggagtgtattgaacttctgcgaaccatatacgtaaatcgagacaattatttccctctgcttgcgcctgttccggcaatgcacttttgttaattcctaaagtaactaactcatcgagcgaaaaacaggggatcaactgattctgctcatcagctttgaaagtaaccttacgtgatgtcaaaggcgaatcattgacccatatttcaacctcataactaccaggtagatatgtcatccctttctcaaaacgagataaatcagcaacagcttctgtatcacccgacaggaatgcagggttaaagcgcatacccgccactgaacacgcaggcaaaagtgtcagtagaagcagcatacaccacctcatctgcttctgccttgccatcctgtgttcgagttttctgagctttaggttcatatccctgacctgagttgctttaacgttttaatcttccaggtttattgcatcgttcccttttgcctggccgttgtggcaccgtaatcattgatagtttgataagtaatttcaccggctaacgtcactggtgaagacactgttacgtcacttttcggtggaacaaacgcattaggtaattttgccccttgcaccctgattccagtcaccgtcagataatagggagaagggttaatgactctcagctgtttaccttcgtatttaaatcgcagcatatcccgtgctttaccagcttgaacgggtaaattagtcggacggtaaaataatttaattctgttttgtaacgccagttgtaacgtgtttttctgggtattcttctcatccgttggcggaatcgctttcacattcatccagaataatgtttcgcgatcagtcggtaactgtgatttaccaataaacattatcctcaatgaggcttcttttcgcgttggtaacataaataaaggaggcgtaaccacaaaatcctgactttttttactgctttgattgtcatcaatccatgactggattaaatagctggtgttagccccaccattctgtacacttagcgtaatttgctgactgtcagatggataaaccagacgcgtagaaccaagaccgaagccacccgcagcaatagcattgatagatatggcggatagtaaaaatagagcaccggcccttatgatatattgggtcttcagcaaagaattaatgtttctattcgaaaaacatttattttttgaaatccatctcatactgcatccttgtagatgaaattaattgtaattactgatgcatgtctatttattacaaataaacatgtaatattaatttcaggttacaagtaactgtaacctgaaattatcttgctgtaattattcgtacagcacgacgaaacttgccgttgatttcaccagacctggtgcaacggtactaccgttctgagcatagcccgcggtaaatgccgcagtaaaatcatgagtggctgcatcgccaggaatcacgtaggctgctgaagaactactcccctggggagtttgtgtgttcagcttaatcaggccatcagttgtcgtgtttttagaataaatacgaatccctacacccgtagctcccgcttcgccagtaccatcagcatcagcagctccttccacttcattggcaagcgtctggttggcaccgtctgctacgccagtaaaacgaaattcaatattttgactgtccgtattgctacaatcagtcagtttaatgttgaagtcagtctggttactggcacccgttgcttcggtatcaatgcccgtgaaagcgttagaaggtacgactggcagtaccacttcaatctgtttcgattctgtagcaaccttacacgtcgctttaaccacacgaccagtaaagcggatgtttccgcccatcgcatcggtgttgctatccatatcggtgagttttggataatcaacggtgctccagtctgtatccgcaccaccaaattgtgatgcatcgcctggcgcagcggttaccgcagttgacatcagcatacctgatgcgagtaaaactgcggataaattagatagattgaatttcatttatacctttccttttgttaaaaaatccaagcaatattggcgattatttttacattcagctttaacaagtcacattatttaaatgaataaagctggtgtagttaaccacagaaaaaaataagagatagaatggctggaaaatattatatgagctgcttggtaatataactaaaagaatccatgctcgcaatgattgactttatataaaaatacagtcatttgaaaacaaagagatttattttagacaggataactgaagagtggggcaatatataaatataataaataatttattagttatttataatgcttattgtatgatacatactcagatgagaatcattattaaaaattaataaatatgaattatatatcgatactgtctgtaaattgtcatgacatatcgtttatctgatataaaaatgccgtgtgccccttaacgatagctttgagggaacacacggcagttatcactttgcaaacttacaatctcaccggatcgatatgccagatatgatcagcgtactctttgatcgtacggtcagaagagaagtagcccatattggcaatgtttagcatcgcttttgcggtccactcttcctgacgctcgtagagttcgtcgactttatcctgacaatcgacataactgcgataatccgccagtacctggtagtgatcgccgaagttgatcagcgaatcaaccagatcgcgatagcgacccggatcttccggactgaatacaccgctgccgatttgcgtcagcacctgatgcagctcctcatctttctcgtagtattcacgcggtttgtagccctgacgacgcagttcttccacttcttccgctgtgttaccaaaaataaagatattgtcagcaccgacatgatccagcatctcgacattcgcaccgtccagcgtaccgatggtcagcgcgccgttaagcgcaaacttcatgttactggtgccggaagcttccgtccccgccagcgaaatctgttcagacagatcggccgccggaatgatcaactgcgccaggctaacgctgtagttcgggatgaacacgactttcagcttgtcgccaatctgcggatcgttgttgatcactttcgctacgtcattgatcaaatgaataatgtgcttcgccatgtaataggccgaagccgccttaccgccaaaaatattcacgcgcggtacccatttcgcatccgggtcggccttgatgcggttatagcgggtaatcacatgcaacacattcatcaattgacgtttgtattcgtgaatacgtttaatttgcacatcgaacagcgctttcggatttaccaccacattcagctgctgggcgatatactccgccagacgctttttgttctccagcttcgcctgatgcaccgcgtgattaaccattgggaaatcacagtgttgttgcagctcattaagcaggctaaggtcggtgcgccagttacggcccaggtgttcgtccagcacagctgaaagcgatgggttcgctaccgccagccagcgacgcggggtcacaccgttggtaacgttggtgaaacgacccgggaagattttcgcaaagtcggcaaacaacgattgcaccatcaggttagagtgcagttccgatacaccgttaactttgtggctcaccacaaccgccagccaggccatacgcacacgacgaccgttggattcatcaatgatcgacgcccgtcccagcagatcggtatcgttcggatactgttcctgcaaggttttcaggaaatagtcgttaatttcaaagatgatctgtagatgacgcggcagaattttacccagcatatcaaccggccaggtttccagcgcctcgctcatcagcgtgtggttggtgtaagagaaaacctcgcaacagaccccaaacgcgtcgtcccaactaaattggtgctcatcaatcagcaggcgcatcaactcaggaatcgacaacaccggatgggtatcgttgagatgaatcgcgattttatccgccaggttatcgtaggttttatgcaactgataatggcggcttaaaatgtcctgaatggtcgaggaaaccaggaaatattcctgacgcaggcgcagctcacgcccggagtaggtggagtcgtccggatacagtacgcgagatacgttctcggagtggtttttatcttccactgccgcgaagtagtcaccctggttgaatttaccgaggttaatttcgctactggcttgcgcactccacaaacgcagcgtgttggtcgcgtcagtgtcgtaacccgggataatctgatcgtaagccactcccagaatctcttcggtttcaatccagcgcgtttttttaccttcctgctgaatgcgaccgccaaaacggactttatagcgcgtgttgtggcgtttgaattcccacgggttaccgtattccagccagtagtcaggtgactctttctggctaccgttaacgatgttctgcttgaacataccgtagtcatagcggatgccgtaaccgcgccccggcaaccctaacgtcgccagagaatcgaggaagcaagccgccagacgtcccaggccaccgttaccgaggcccgggtcattttcttcatcaatcagctcttcgagatttaaccccatcgcttccagtgcgccctgtacatcttcgtaaattcctagcgacaacatggcgttggaaagcgtacggccaatcaaaaactccatcgacaggtagtaaacctgacgagtttcttgcgacaactgggcacggtttgaacgtaaccagcgctccacgagacgatcgcgcacagcaaataacgttgcgttcagccattcatgtttattggcgacgaccgggtcctttccaatcgtaaacatcagcttgtaagcgatagagtgcttaagagcttctacgctaagcgtgggcgatgaatatgtaaacggagcattcatataggcgtttcctgaaaactatttcaagcgatagtaaagctcacggtacgacttcgccgcgacctgccagctaaaatccattgccatagcctgacgttgcacaaaccgccacagtgaaggacgggaccacagtacaaaagcacgtcgaatagcccgtaacagcgaccaggcattactatcttcaaagacaaacccactggcgacgccatctgcaaggttctcaagagaacagtcagaaaccgtatcagcaagcccaccggtgcgccgcactaacggcagcgtaccgtacttcaatccataaagttgcgttaagccgcacggttcaaaacggctgggcaccagaatgacgtccgcgccgcccataatgcgatgcgaaaatgcttcgtgatagccaatctgaacgcccacctggccggggtattccgctgccgccgcaaggaaaccttcctgcagcaccggatcgcccgcgccgagtagcgccagctgcccgccctgctccagaaggcccggtaaggcttccagcaccaggtcgagacctttctggctggtcagacggctcaccactgcaaaaagcggcactttatcgtcaaccttaagccccattgcgatttgtaactggcgcttattttccgctttatcttccaacgtatcgcgggtgtaacgcgaggccaacagtaagtccgtctctggactccagattttctcgtccacgccgttcagtacgccggaaagacgcccttcacggtgacgctgttgcaacagaccttccataccgtaggcaaactgcggttcggtgatctcgcgagcgtaggttggactgactgccgtaatgtgatcggcatagtacagaccggccttcagaaaagagatttgtccgttgaattccagcccatgaatattaaagaatgaccatggcaattggatgtcattcatgtgatgtgcataaaacatgccttgataggccaggttgtgcacagtaaacaccgacttcgcaggacgcccgcgcgccgccagatacgcaggcgcaagacctgcatgccagtcgtgcgcatgcaccacatcaggacgccagaatgggtcaagcccgctggccatttctgccccaacccaccccagcagcgcaaaacgcaatacgttgtcggtataggcaaataagttggtatcgtgatacgggcttcccggacgatcatagagatgcggcgcgtcaatcaggtaaatgccaaccccgttgtaatgaccgaacaacagcgtgatatgtccggcgaaggtatcacgacgggatactacctgcgcatcggtcacgccacggcgaatatcgggaaatgcaggcaacagtacgcgagcgtcaacgccgtctgcgatttgtgctgcgggtaatgccccaataacatcagccagaccgccggttttaagcagcgggaacatctctgaacatacatgtaaaacctgcattatcgctcctgtttatgccctaacttccgtagcatttcgcgcgttaccagcacgatgccttcttctgaacgatagaaacgacgtgcatcttcctctgcgttttcaccaatcaccatgccttccggaataacacaagcacgatcgatgacgcagcggcgcagacggcacgagcgacctacccatacttccggtaacaatacggcggaatcaatgttgcagaatgaattcacgcgaacgcgcgagaacagaacggactgcaccaccaccgaaccggagatcacacaaccgccggataccagtgagttaagggtcatcccgtggctaccggagcgatcctgcacgaatttcgctggcggtaatgattcattgtaggtgcgaattggccaattgcgatcgtacatatccagttccggcaccacagaggccagatcgaggttcgctttccagtaagcttccagcgtacccacatcgcgccagtacggctcggcatccgggtcggattgtacgcaagagagcgggaacgggtgcgcataggccagaccggcttcggtgatcttgggaatcaaatctttgccaaagtcgtggctggagttctcatcgcgatcgtcttcttccagcagttcatacagatagtcggcgtcaaagacgtagatacccatactcgccagagatttgctcggatcgttcggcattgacggtgggttagcaggtttttcaacgaattcgataattttatcgttctcatcaaccgccataacgccaaatgcggaggcttcttcaatcggtactggcatacaagcaacggtgcaacgtgcgcctttttcgacgtggtcgataagcatacgcgagtagtcttgcttgtagatatggtcgcccgccaggatcaccacgtattccgctttataacggcggataatgtcgaggttttgggtaactgcatctgcggtgccgcgataccagttttcccctttcattctctgctgtgctggcagcagatcgacaaactcattcatttcttcattgaagaatgaccagccgcgctgaatgtgctgcaccagagtgtgggactggtactgggtgatcacgcccatacgacggataccggagttgatgcagttagacagcgcaaagtcgataatgcggaacttaccgccgaagtgtacggccggttttgctcgcttattggttaaatccttcaggcgggtaccacgtcctcccgccagtatcagggcaacagatttcaatggcagctggcgcgccaacattaagtgatcgttcttctctaaactaaccatgactaactccttttttatcatctctggaacacacacaatccgtgtgcaggtccctgccagacagccgtaatcactgggttatcctctccagcgaatgggggaatggcgtgccactccccagcaggtaaaacaatctctgttacctcaagcgtggcgttaattgcgatcaaaaagcgatccgagagcagaatttgcagctgtttcggcccgttttgccactcatccgtgcttaaaggttgagcatatcgatttagccaacggacattgccgtcgccttcttcccaccagcgattctccaccaaagcgggaatgcgcttgcgcagatggattaacgcggcggtaaatgcggttaaaccactgcttgcctgcgaccagtccaaccaggttaattggttatcctgacagtaggcattgttattgccatgctggctgtgaccatgttcgtcaccggccagtaacatcggcgtaccctgggagagcaacaacgttgttaacagggcgtgaatgctgtcgcgacgccgttcaaccaggtcaagagtaccgcctaacccttctttaccatgattgttactgtaattgttgttggtcccgtcgcgattttcttctccgtttgcttcattatgtttatggttgaagcaaacgcagtcgcgaagcgtaaaaccgtcatgcgcggtgacgagattaatcgcggcactcggcagacgaccattacgtttaaaaacatcgctggaggcagcaaaacgcccggcaaacgcccccagaggcaaatcataatgaagccagaaacgacgggcagcatcgcggaaatgatcgttccactcggcaaacagcggcgggaaatttcccacctgataaccaccaggagcaatatcccacggttcagcaattaacttcacctgcgagagcaccgggcagttctggatagcggtaaacaacggcgcatcctgacggaactctggcgtacggcccatgactgccgccagatcaaagcggaaaccatcgacgtggcaggtttctacccaataacgcaggcaggcgctggcataatccaccaccgccggatgactcaaattgagcgtgttgccacaaccggtccagttgtgataatcgccgtcttctcttatccaataatagctacggttgtcgatcccacgcagagagaataacggaccgtcgaggtccagttccgcactatggttgagcacgatatcaagaatgacttcgatacccgctttatgcagtgctttgattgcatcgcgaaactcatccagcgccgtttctggggagcaggcatacgccggatgcagtgcaaacatcgccaccgggttgtaaccccagtagttacttagacccatacgttgcaggcgtggttcgctggcaaactgcgccaccggcagcagttccagcgcggtaatgcccaactgtttcaaatagttgatcatcaccggatgccccagggctttataagtgccacggatctcgaccgggatctccgggtgcaggtacgttaatcctttgacatgggcttcataaatgatggtactgccccacggcgtgcgcggcggggcatcatcctcccagtcatagtgatcaaccaccactacgcatttcggcgcaatggcggcgttgtcgcgatagtcaggttcattatgaccggcgtgcagcagcgggttatctttaaattccccgtcaatttgccgcgcgcaaggatcaatcaacaacttcgccgggttaaagcgatgcccctcggcgggttgccaggggccatgaacgcgataaccataacgcaaacccggacgcgcatccggcagataaccgtgccaaatgtcgccactgtgccctggcaagtcatagcgatgttcctggccattggcgtcaaagatacacagttctacccgctcggcatgagcggagaaaagtgtgaagttgacgccctgaccgtcgtaatgcgcgccgaggggtgcgggtttgccaatggcgagttgtgtcattctgcctcccgaaccagccagatagtggccagcggtggtagcgtcaggcttagtgaatgctgacgaccgtggctggcaatctcatcgctgtgtaccgtgccgccattgccggcattactgccgtgatagtgcatggaatcggtattgaggatttcacgccatttgcccggctggttaatgccgaagcgataatcatgacgcggcaccggagtaaagttactggcaacgatgatttcgttaccctctttatcgcgacgcacaaagatcagcaccgagcgttctttgtcatccaccaccagccattcaaaaccgtacgggtcaaaatccagttcatgcatcgctttatggtggcggtaggtgaggttcagatcgcgcaccagacgctggacaccgtggtgccagttatcgccgccttccaacagatgccagtcgaggctggtgtcatggttccactcgcggccctgggcaaattcgttccccatgaacagcagtttcttgcccgggaatgcccacatccagccgtagtaggcgcgcaggttagcgaatttctgccatgcgtcgcccggcatccggtcgagaatcgattttttaccgtggaccacttcatcatgcgacaacggcaggacgaagttttcagtgtagttgtagagcatcccgaaggtcagtttatcgtgatgatactgacgataaaccgggtcgagcttcatgtagtccagggtgtcatgcatccagccgaggttccacttgtaccagaagcccagaccgcccatgtcctgcggacgagaaacgccagggaaatcggtagactcctccgccattgtcaccgcaccggaaacctgctcaccaagaatacggttggtattacgcaagaattcaatcgcttcaagattctcgcgcccgccaaattcgttcgggatccactcccccactttacggctgtagtcacgataaatcattgacgccaccgcatcgacgcgcagcgcatcaataccaaaacgttcgatccagtaaagcgcgttaccgacaaggaagttactgacttcacggcgaccatagttgtagatcagcgtattccagtcctgatgatagccttcgcgcggatcgctgtgttcatacaagttcgtgccatcaaattcggcaagcgcaaagtcatcggtcgggaagtggcctggcacccagtcgagaatcacgttcagaccagctgcgtgtgcggcatcaatgaaataacggaagtcgtcgcgggtaccaaaacggcgggtcggtgcatacaggccggttggctgataaccccaactgccatcgaacggatgctcgttaatgggcagcagttcgaggtgggtaaagcccatccatttagcataaggcaccagttgatcggccagctcgcggtagctcaaccagaaattgttgtcggtgtggcgacgccaggagcccaggtgaacttcataaatagagattggcgcatcaaactgattcgcttttttgcgctcttcagtctgcacaaccttttccggtagtccgcaaataagagacgcggtttccgggcgcatttgcgcttcgaaggcataagggtcggacttcagacgcaagttgccattggcatcaatcatctcatatttatagagctgaccgttatgcgccccagggataaacagttcccagatgccgctctctttacgcaggcgcatcggatgacggcgaccgtcccagtagttgaattgcccaaccaccgagacccgacgggcgtttggagcccagacagaaaaacgcgtacctgtgacgccatccatagtatctgcatgcgcgcctaaggtttcatacgggcgcaggtgagtaccttcagataatagccaggcatccatttcctggattagcggaccaaaacggtaaggatcatctatcaggttttgctgaccatgccagacaacagccaactgatagcggaaaaaattcttacgtcgcggaatgacaccgctaaagaatccacgggagtcgagacactccagttttgcgagtttgcgcccggttttcggttcaatcacccacacatcggtagcgtcgggtaaaagggcacggacttccagtcccgcggtggttttatgcatccccagtacggaaaaaggatccgcaaaatggcctgcaattagcgcgttaatcacgtctctatcgatacgatcggacatgcttgtcttcctgttttattgtgtcaccccatccaactggatttttgacttctggttgtgacatttttttgacctgaacggcgcagcactctgtgcatcctctctgcgtcgtcctcacttcaggtaaggctgtgaatactcatgtattcagccacccttaaagaatagccaatgctctatttaactcccggtaaatcatgaaacatctgcgcttactcctgtattacgcactaacaggggcggcatcgcgccccagatttaatgaataaagattacgccagttgacgaagcatccgacgcagcggctccgcggccccccacagcagctggtcacccacggtaaaggctgacaggaactctggtcccatattcagcttacgcagacggcctaccggcgtggtcagcgtgccggtaacggcagctggggttagctcacgcatagtgatttcccgatcgttcggaacgactttcgcccacggattgtgtgcagccagcagttcttccacggtcggaatagacacatcttttttcaatttaatagtgaatgcctggctgtggcagcgcaatgccccgacacgcacacataaaccatctaccggaattacggaagatgtgttgaggatcttgttggtttccgcctgccctttccactcttcgcggctctgaccgttatcgagctgtttgtcgatccacggaatcaggctacccgccagcggcacgccaaagttatccaccggcagctcaccgctacgggttaaggttgtgactttgcgttcgatatcgagaatagcagaggacggggtcgcgagttcatctgccacatggccatacagatggcccatctgggtcaataactcacgcatatgtcgcgcaccaccgccggaagcggcctggtaggttgcaacggacacccaatcaacaagatcattggcgaataaaccacccaacgacatcaacatcaggcttacggtacagttaccgccaacaaaagtcctgatgccattatttaatccgtcggtaatgacgtcctgattgacggggtcaagaatgatgatggcgtcatctttcatgcgcagagacgatgctgcgtcaatccagtaaccttgccatccgctttcacgaagcttcggatagatttcgttggtataatcgccgccctgacaggtcacaatgatatcgagggcctttagcgcctccagatcaaaggcatcctgaagtgtgtcagtagttccgccaaaagacggcgcagcctgaccaagctgagaagtagaaaagaagacagggcgaatggcgtcgaagtcgcgctcttcaaccatgcgttgcatgagaacggagccgaccataccgcgccagccgataaaaccaacatttttcataagcgttttttcctgcaaagatgtgtgctgtataaatgtgccggtctcctcttggcacatctttcaccatacaaaaagcagccaaagtcgcaagtgaaattaatcaatgatagcgaagccatcagtaatgcgacttatcctgctttgttagcacgcagaaagtccgcggcaattatcagggaatttgagttatgaatgaaatcatttctgcagcagttttattgatcctgattatggatccgctcggaaacctacctattttcatgtccgtactgaaacatactgaaccgaaaagacggcgggcaatcatggtgcgagagttgcttattgctctcctggtgatgctggtgttcctgtttgcgggtgagaaaattctggcatttcttagcctgcgggcagaaaccgtctccatttctggcggcatcattctgtttctgatcgccattaagatgattttccccagtgcttcaggaaatagcagcgggcttccggcaggtgaagagccgtttatcgtgccgttggcaattccgttagtcgccgggccgactattctcgccacgctgatgttgttgtctcatcagtacccgaatcagatgggacatctggtaattgctctgctactggcctggggcggcacctttgtcatcctgctacagtcttcgctatttttacgtctgctgggcgagaaaggggtgaatgcacttgaacgcctgatgggattgattctggtgatgatggcaacccagatgttcctcgacggcattcgaatgtggatgaaggggtaacgaggagagtttttcgaaaagagcccggtagcgtcacaactaccgggcgaacaaacttaactcaacagctggaaagcaatcatcccaacgatggcaccaacagtgccgaggatggtttccatcatggtccaggttttcagcgtttcggcttcggtcgcgccggtaaatttaccgaacaaccagaaaccggcgtcgttaacgtggctgacaacaatcgaaccaccggcgatacaaatcgacagcgccgccatttgcgcaccggagtagttcagttgttcaataaccggcatcaccagtcccaccgccgttaaacaggcaacggtggcagaaccctgaatgatacgcaccgccgcagccagcacaaagcaggtgatggcaatcggcaggcccatgccggttaacgcttcgcccagtgccggacctacgccagagtcaaccagcacctgtttgaacacgccgcctgcaccaatcaccagcagaatgatccccgccggttgcagcgcgtgaccgcaaatctccatcactttgtcttttggcatgccctgacgcattgccaggccataaatcgctaccagacaagcaaccagaatcgcggtaaacggatgaccaataaactcgaaccattcgtaagcggtagagccttctggcacaaaacgcgcggcaatggttttcagccctaccagcaccagcggcaacaggatcagcgacaggctgaatccgaaagatggcattttgccttcgccgagatgcggttcgctgatgtcgtcaggaatatgcaactccacgtagcggctgatgaaattaccccacagcggcccggcaataatcattcccggaattgccgcacacaggccaatcaggatcatccagccaaagtcggcgttcatctgcgatgccagcagcattggcgctggccccggtaccaggaacgcagccgcggccgccacgcctgcgaataatgggattaccagtttcaccaggttcgtaccggtgtggcgcgccattgagaaagcaacgctaatcagcagaacaatcgccacttcaaagaacagcggtagcgcacaaaccagccccgcaaggccgatggcataatgtgctcggctgtgaccgaaggatttgagcattttgacggcaatctgatcgactgcgccagtttcatgtaagatcttgccaaacatagctcccagggcgacaaccaccgccaggaagccgagggtgcctcccatccctttttccatcgtcgctgcgattttatcgagcggcataccggaaaaaaggccagcccccatggacaccaccatcaaagccaggaaagcgtgcatacgcgccttcatgactaaaaacagcagcagtaaaacagaccctactgctgttaaaacaagcgttaatgtagtcactacttatttgccttttttaataacctcaatggtgcttgccacaacaccttccagcggttgatcgatatccaccaccagtacatcggtttcgtccgcacccggctcctgcagcgtttcaaactgcgtcaccaacatttgggttttaaagaaatggcctttgcgcgctttcaggcggctttcaatcacatcaaaatcgcctttcaggtagatgaacgagagattcggattaccttcacgcagcaagtcgcgatagtgttttttcagtgcagaacagacgatcagcgacactttattggtgcgctgcatagcaaacgcggcgtcgttcagcgcctgcaaccacggtttgcgatcgtcgtcattcagcggttcaccagacgccattttttcgatattgcgccttggatggaggaaatcgccatcaagaaacgcggcatgaagttgatgcgccacttcactggcgaccgcagatttgccgctgcccgatacgcccatcaagacgtaaatgtggtgatcatggttagtcgtgctcaaagtggtgcccccacaatacaagaaataaaaatgttacgggtaactgttatcggtaacattgtccggccggacaatatcagaagcaatatccatccgtgccttaagtgtataagtgtgagctacttcaaatttgtgggcttaaatagatccgcccggtgacaaggtgaaacctaaatctaacattttcggtgtcacagattcgccacgaatacgcgccagcaggcgttcagcgccaatactgcccatccgctcacgcggcgtcagtacgctcgccaaccgtggttccatcacctgaccaatgtcatgaccatggaaaccggcaatcgccatatcgtcaggaactttcaaccccagacgctggcattcaaacgccgcgccgaccgccaggtcatcattagtacagaacacgccatccagctgcggatattcccgcctcgcctggcgaatcagttcaataccggaagagtaagaagaagattgctcaaccatcacgctatacggcaccaggcctgcatccagcatcgcctgttcgtatcccttctgtttgatgatagtacgttcgtcgagacgtgcgccgagataggcaatgtggcgatgcccgcgagcaataatggcggtggtcatctggcgtgccgcttcaaagttatcaaaaccgacggcaatatcgaggcacggcgacttgctgtccatcaactccaccaccggaatccccgccacttcaatcatctttaaggtgcgtggcgtgtgggtacgttcggtgaggatcagtccatcgatattccatgagagcattgattcgaggcgttcttgctccatttccggtttataaccgtagtgcgccagcatagtttgataaccgtgcgcgtcggtgacgctttcgattccgcgtaatacttccgcgaaaacctggttggtgagagaaggtaacaggacgccaatcgcccggctggtggcattagagaggatatcgggcgcgcgattgggaatataacccagttcatcaagagcggcggcaatcttgccgcgtagagcgacggaaacctgctccgggttgcgtaaaaaacggctgaccgtcattttggtcacgcctacacggtcagccacatcctgaagtacgggtcttttctttttcatcgtcctgaaggtacaaaagagatagattctcttagtttaacacggacgcatcagaaccttcccggggaaaacagtgcttgtttacaattattagatatacactaaatcaattgcatcgcattgtgctaacgacgcggcaaaaccccggaagcgtacatcagcacgcgaccggagcgagtgaggaagcctgcaaaaaggcaggcttcaaagatgccgttgagttttaaaccggcggcagatcgaacagtaacacttcgctgtcgctatccgcatgaatggagattgcctgctcatcccagattgccagaccatcgctggtcgaggctttcacgccgttaatggtgacattgcctttcaccacctgaatccagacgcggcgttcagcggcaatctgatgcaccgactgctcatcttttaccagcgcccagcggtacagttccatatcctgatacactttcagcgaaccatcacgcgcatccggcgagagcaccagctgtttgccctgtacggcatcgaagcgacgctgttcataacgcggcgtaataccgttttcttcaggcatgatccagatttgatacagatgcagacgctcggtgctgcttgggttgtactctgagtgacgaatacccgtacccgcactcataatctggaactcacccgccggaacctgctctttattgcccatgctgtcctgatgctcaacagtaccttccagcacgtaggtcaaaatttccatatctttatgcgggtgagtgccgaagccctgccctgcttcaatcacgtcgtcgttaatcacgcgcagcgcggagaagcccataaagttcggatcgtaatagttggcaaaagagaaagtatgccaggagtccagccagccatgatttgcatgaccacgttcatttgctttgcgtaagtagatcatttttattcgccccctgaatgatttcgatgggcttagtgtggacccgatccgcctgggatgatagagggtgaaaattgacccctctgttcaaaaaaattgaactattcgaggggccatcaaacttacttcgcgagagtcactgtggagggagaggcttgctcaaatcctcgttcaaggatttccagattggtaagaacttcagattccttgacgtaatttggcgcaccgttggtgatggtttgatacaacgcatcataaacgcgcccgtaatcgcccatctccggcttcatctcttctctgaccgtcacaccctcgtcattgacatactccagcacaccgaccgaatcatccgctgcgaatcccggttcgcccggcataatattggccttgaggctggtttcctgctggtcgataccgtatttaataaacgaacctttcttaccgtgaacgataaatttcggataatcgattttcaccagatggctggttttgacgatggctttcaggtcgccataaaacagctgcgcttcaaaggtgtcgtcaggattggctttattacgcaggctgcggatgtcataagcgacgtgatccgggcgaccgaacagagaaataatctggtccatcgtatgcacaccaagaccatagaacgcgccatcctgcggcagcccaggtttggtttctgccaccgggcggtaatagtcaaaatggctttccacttcgacaatctctccaagcttgccgctttcaatcgcttttttcgctgtcaggaagcaggaatcaaagcgacgattctgatacggcgtgacggtcagccctttgcttttcgccaacgcaaacagctccttcgcctgggcaagcgtcggggtgaacggtttttcgaccagcacatttttcccggcttccagcgcgcgcttcgcgtactcgaagtggctgtctgcatgggtgcagaccacaaccagcttaacatcgggatcgtttagtacttcgtcgagatcgctggtgaaatggatatgagagtaaatgggggcctgttcttccggcttcgcatggcggcgaaaaatatgcgcgacatgccagctatccttgcggttaagtacatacggcagatggtaacgggtggtgcttttgccgaagccaataaaggcgcagttaatgaccatgatttcgtcctttttaagggggttatttacaccttagcgcaaagcggacgtggttcctactggagtgcgcataacgaacacaagcacttcccgtggataaattgaaaacgaaagatcaaaaaaaaagccagcacccggctggctaagtaatactggaagcaatgtgagcaatgtcgtgctttcaggttctccgcgagggtcttcctgatcgcgagacaataataatcattctcattcgcacttgtccaacactttttgcaaaaaaaatgcatttgactcgcatttgaaagtcaatgatgttgaaagggacatttaccccaaagaggacaaaggaatgagtgagatagtgatacgccatgctgaaacgcgggactacgaggccatcaggcagattcacgcccagccggaggtgtattgcaacacgctacaggtgcctcatccctccgatcatatgtggcaggagcgactcgccgatcgccccggcatcaagcagttagtcgcctgtattgatggaatcgtcgtaggccatctcaccattgacgtgcaacaacgcccacgccgcagtcatgttgccgattttggtatctgtgtcgactcccgttggaagaatcgcggtgtcgccagcgccctgatgcgagagatgattgaaatgtgcgacaactggttgcgggtagatcgtattgagctaacggtgttcgtcgataacgcgccagcaattaaggtctataaaaaatttggatttgagattgaagggactggcaagaagtacgcattacgtaatggtgaatatgtcgatgcgtattatatggcgcgggtgaagtaagatagtgccctttttctgagatggaaaaagggtgtcattcaaaatcggcataccttcctttaaggtatttattttcccaataaatatataagatttacctcataattacgtcctaaagtgtaatattttattttttaatatatacgcctacaatttcctggagtaaataaataacaattaacaagcataatagtgccattgataaaatagcatgccataaaaggacttttcatggatgagtaatattgtttacctgacagtaacgggagaacaacaaggaagcatctccgcaggttgtgggacttctgagtctacaggtaatcgctggcagagcgggcatgaggatgaaatatttacattctcactcttaaatagtattactaatacggggcttggttcacagttccatggtataacattttgtaaattaattgataaaagcactccattatttattaattccattaacaataatgaacaattatttatggaatttgacttctatcgaataaatagatttggtagatgggaaaagtattattatatacaactaagaggcgcttttttatcggctattcatcatcagatcattgaaaatcaactggatacagaaacattaactgttagttatgaatttatcctctgtcaacatcttatcgcaaataccgagttcagctatttggcactccctgaaaattataactgtttgtttttaccaaattcaaaaaaccaaacaaataatcgtttcaaaacgttaaacagcaaagctattggcaggctacttgctgctggtggcgtatacaatgggaacattgaaggattcagagatactgcggaaaaactgggtggagatgcaataaaaggctatgatcaaatactaaatgaaaaaacagcgggcatagcgatagcaacagcatctattcttttaacaaagcgttctaatgttgatacatatacagaaataaatagttacttaggcaaacttagaggtcaacaaaaacttcttgatggtatagacataatagaaataatatacattaagagaccttcaaaagacttagctaacttacgaaaggagtttaataaaactgtaagaaaaaattttcttatcaaacttgcaaaaacctccgaagcatctgaaagattcaacgccgaagaccttttaagaatgagaaagggcaatgttcctctaaattataatgttcaccataaactatctctagatgatggtggtactaatgatttcgaaaatttagtattaatcgaaaacgaaccatatcataaagtttttactaacatgcaatcacgaatagctaagggagtattagtaggtgaaagcaaaatcactccctgggccattccatctggctcaatttatcctcccatgaaaaatattatggaacccacaaaatgatgactaaaacccaaataaataaattaaaaaaaatgatgaatgatttagactatccatttgaagcaccgctcaaggaatcatttattgaaagtataatccaaatagaatttaattctaattcaactaattgcctggagaaattatgtaatgaagttagtattctttttaataatcaacctgattatcttaattttttaagagcaatggatggattcgaagttaatggattacgattatttagcctctcgattccagaaccttcagttaaaaacctttttaccgtaaatgaattttatagaaataatgatgatttcataaaccctgatctacaagaacggttagtgatcggggatgatagcatttcaatatttacttatgacattaaaagtaacttttttgaaattagagataatattggcaccgaaaatatattcagttcgtttagtgatttctcttcattcttaaacgaaatcatggacagttgttcataataatcaaaaggtaacaaaaatcattgtaaaccatgccatctttttagagattaccagcagaaaattccttgttcgaaacttagcaatgcaagctatggaaaaacttacaacggaactacactccttaagtgagatggaccgaagacatgtaatctctattttagccgaaatagctaatggctatgatgattttagtgacatgttgatttagttagaacttcacccgaatcataagattctgatatcttaaataagaaaatcccgttcgacgttctgaaaaagaaatcacaaaatattagcagatacttatttcgtgactgtatattatccgatgaacttttttcaaaaccagcatttaataatatatttgacgaagatgaacgcgtcttttctcaaagtataacgcaagaataataatataacgatcaacaataatatttattataattatgattacttatcacgacgcattcgcgaaagcgaaccattaccttgatgatgcagatctcgccgtcgtcattactctacatggacgctttagccagggctggtatttctgtttcgaagcacgagaatttctcgaaactggtgatgaggccgcgcgtttatccggtaacgcaccttttattattgataaagacagtggtgaaattcattcccttggaacggcaaagccgctggaagaatatctacaggattatgaaataaaaaaggctaccttcggcttgccctgacaatacggccctcttcccacgaagagggccgctaaccttaataccccgccgttaaatcatccaccgagcgcggatcggatgcaccgtacagctcaccgtccggcccaaccataatgctttgtgtactgcccatcgcctctttcagcgccactttctgaccttttgcttccagcagcttgagcgtatccgggctaaaccctttttcgacacgcagctcgtccggcaaccattgatggtggaaacgcggtgcattggtcgcttcagcgacattcatgccataatcgatgctattcaccaccatttgcagcacggtggtaataatccgactcccgccagggctaccggtaaccagccaggttttaccgtctttcaccacaatggttggtgacatcgacgacagcgggcgtttgttcggcccgaccgcgttggcatcaccgcccaccagcccgtaaacgttcggtacgcccggtttggcggagaaatcatccatctggttattaagcagaataccgctctcgcccgcgacaatgcccgtaccgaaggtggtgttcagcgtataggtcaccgccaccgcgttgccgtctttatccaccactgagtaatgggtagtttgattactctcataaggcgcaagcttgccggggcgaatttcgctggatggcttcgctttattgatatcaatttgatcggcaatagatttggcataggctttattggtcagcgcctgccacgggactttcacaaaatccggatcgccaagatattccgagcggtcggcgtaggcgtatttctccgcttctgccatgatttgcatcgcatcggcgctgccaaagccgtatttctgcatatcgaagttttccaggatattgaggatctgcacgatatgaatcccaccggaagatggcggtggcatcgagtaaacctgatacccgcgatattcgccgctaatcggtgtacgttcgaccgctttatacgccgctaaatcttctttagtgatcaagccaccgtttttctgcatctcctgagcgatctgctccgctattgtgcctttgtagaattcgtccgggccgttttcggcaatcatctccaggctctttgccaggttcgcctgcaccagcttgtcgccctttttcagcggcgcgccctctttccagaagatagccttgctgttttcgtgattcggcaacacttcgctaccgtaggttttgagatcgtcagccagcgcgtcattaacgataaaaccatcgcgtgccagtttaaacgccggctgcaccactttatttaacggcatggtgccgtacttctccagcgccagcgagaaacctgcgaccgtacctggcgtaccggaggccagatgcgaagtgagtgattttttgctgtccgggttgccctggtcatcgaggaacatatcgcgggtcgctttggcgggtgccatttcgcggaaatcgatagcggtggtattgccatttttcgagcggatcagcataaaaccaccaccgcccagattccctgcctgcggatgcgttaccgccagcgcgtagcccacagccacggcggcatcaacggcattcccgccctccttgaggatatccacccccacctgagtggcagtagcatctacagacgccaccatcccctgtttcgcgcgtaccggatggaagacatcttcctccacgccataagaaacaggtggcggaggaggcgcggcggaggcgctaaaacaacttcctgagagcagagcagcaatggccacccggcgtaaaaacgtcggttttatcatcgttattctccagagattaaggggcaaccccagctaagcctggtatataactctgaattaatcatcgttttgccgggaagcgagtaaacttaaaggatatcttcagaggaggatacgcgatgaaacgacttctgattcttacggcactcctgccgtttgtcggctttgcacagcccattaatactctgaacaaccccaaccagccgggatatcagatccccagccagcagcggatgcaaacccaaatgcaaacgcagcaaatccagcaaaaagggatgctgaatcagcaactgaaaacgcaaacgcagctgcaacaacagcatttagaaaaccagataaacaataattctcagcgggtgttgcagtcacagccgggggagcgaaatcccgcccggcagcaaatgctgcccaacaccaatggcgggatgttaaacagcaaccgtaatccggatagttcgttgaatcagcagcatatgttgccggagaggagaaacggcgacatgctgaatcagcccggcacgccgcagcctgatataccgttgaaaactattgggccgtaaagttcggaccaatcacatcaatcgcatcggtacagatgcaatccacgccccagcgcagcaactctgccgcgcgctggggtttattgacggtataaaccagaatccgtaatccggcgtctttcaactgcatcactcgcgctttatcgagcaacttatgattgagatgaatagagacgcagcccagccgcgcggtcagttctcgccagtcgtcgcgccactcatcaagcaataaaccgcgcggcagttctggtactgcttgttgcgcggcttctaaagcatcaatctcaaacgatgacagcagcggcgacgtcataccagcccacagttcgcgtgcagccagcgccaccattttgcccgttaatggcccggtgccagtggtgggcttgatttcgatattcgccatcatcccgtgttcacgacagcgttccgccacctgcgaaagcaacggcagcggctcacctttaaacgctttgctgtaccaactgcccgcatccacgcgcagtaaatcctgccagttcagttcacccgcgacgccccagccgttgctggtgcgttcgagattgtcgtcatggagcaagaagatctcgccatccttcgataacttcgcgtcaaattcgatcatcttatgaccgtattttgcccccacgtcgattgccgccagggtgttctccggggccagtttaccgccgccacgatgggcgacgatgcggggataaggccagttactcatactcgttgtcctgtttcaccatcaaaaagatgcagctgattttccggcagatgcagccacagcgtgctgcctgccgtcgggcgctcctgatgcgccagtcgcaccaccagcttctgttcgccccagcgtccgtgcgccaggttatctgcgccgaggatctccagcgtgtccatcaccagcggcacgccaccttcagcctgcgaacgtagcgtaatatgttccgggcgaatgccgagagtcattttacgtccagcatactgacggtagccaccgtttagcggcagcgcgataccgccgtccagttcgaaatgcgtgccttcgttattcacacgccctgccagcagattcatcgccgggctgccgataaaactcgctacaaacaggctggcgggcttttcgtacacttcaactggcgtgccaatctgttcggcaacgccgccgttcatcaccattactcgctgggcgagcgtcatcgcctcaacctgatcgtgggtaacgtagagtgaagtcgttttcaggcgacggtgcaactgttgcagttcaagacgcatctgcacgcgcagcttggcatcgaggttagagagcggctcatcaaacaagaacaccgacggatcgcgcacaatcgcgcggcccatcgccacacgctggcgctgaccgccggaaagctcgcgcgggcgacgtttgagcagaccgtccagctccagaatgcgcgccgcttctttaacgcgctcggcaatttgctgcttgcccatgccgcgaattttcagcccccacgccatgttttcttcgacgctcatatgcggataaagcgcgtagttctggaacaccatcgcaatcccgcgatctttcggctccatttcggtcacccgctggtcgttgatccagatatcgccttccgtcacccgctccaacccggcaaccatgcgcagcagcgtcgatttcccgcagccagacggcccgaccatcacgataaattcgccatccgccacatcaagggtcagcggtttaatcacctgggttttgccatcccagcttttggttactgcctgtaatttcagtcctgccatcttatttctcactatcgaccaggccgcgcacgaaggcacgctgcatcactaaaacaatcactactggtgggatcagggttaacaacatcgccgccatcaccgagttccattccgtggtgccttcgcctgtggcgatcatccctttaatccctgccacggtggtgcctagatccacgtcggtaataatcaacaacggccacaaatactggttccagccgtagataaaggtgatcacaaacagcgccgccagattggttttggacagcggaaaaacgatgtcgcaaaagaaacgcattggtgatgcgccgtcgatccgcgcggcttccaccagctcatccggcagcgtcataaagaactggcggaacaggaaggtggcggtcgccgaggccatcagcggcagcgttaagccggcgtagctgtcgagcatcttcagattggcgatgacttccaccgtcgggaaaatacgcacttcaaccggcaacatcagagtaataaaaatcatccagaagaagaggttacgcagcggaaaacgaaaccagacaatggcaaatgccgagagcatcgagacggtaattttgccgagcgtaatgctaaacgccatcacaaagctgttaagcaacatccgccagaacggcgcgctattcgtacctaccccgtttacccagatgttgtggatattttccagcagatgcgtgccggggatgagcgtcatcggcgcggcgtagacggcctgtttatccagcgtcgccgcgacaaacgccacgtacagcgggaagaggatcaccgcgatcccgaggatcagcatggtatggctgaatattgtcagccacggacggttctcaatcattggtaacgcaccttgctttcaacatagcggaactgcaccaccgtcagcacgatgacgaggaacatcaacaccaccgactgcgcggcagacgaagccagatccagtccggtaaagccttcgcggtaaatcttataaatcagcgtcgtggtggcctgaaccggcccgccggacgtggcggcgtcgatcaccgggaaggtgtcgaagaaggcgtataccaggttcaccaccagcaggaagaaactcaccggagcgataagcggcagcgcaatcttaaagaagcggcgaatcgggcctgcaccgtcgatggctgcggcttcgatcaacgaacggggtatggattgcagcgcggcatagaagaacaggaagttgtagctaatttgcttccacaccgaggcaaacaccaccagaaacatcgcctgaccgctgttttgcgcgtggttccagtcgtagccgaactcagcgagaaaatgggtgatcagcccgcgaccggggttaaacaggaagatccataatacggcggcaacggcgggagccacggcatacggcagcagcattaaggtttgatataaacggctgccgcgcacgatgtactccaccagcgctgcgaagaacagcgataccagcaaaccgctgacggtgacaaaggtgctgaattttatcgtcgtccagaaggagtcgagatagtagctgtcatgaaacaacgtgacgaagttatccaggccgacaaactggctggagaaaccaaacggatcgacgctttgtagcgagtaccacaacgcttcgcccgcaggccagataaaaaagataacggtgatgatgagctgcggcgcgaccagcaaataaggcagccagcgcgagcggaacaccggacgggatgatgacattacggttaattcctgaactgtgccggatgcgcttcgcttatccggcctacacgcgatgccaggtcagataagcgaaacgcatccgacattacactgattaagacttcgtcgatttctcaaaacggcgcagcaactgatttccacgctcaacggcagtatccagcgcctgctgtggcgtcttcttaccggtccacacgctctccagctcttcatccacaatcacgcggatctgcggcatattgcccagacgcaaccctttggtgaacggcaacggcggcttgttcagcatctgacgcgtcgcggtatccgcccctgggtttttctcataaaagccctgctcacgggtcaggtcatacgccgctttggtgattggcagataaccagttttctgatgccactcggcagcgttttctggcttcgcgaggaagtcgaggaacttcgccacacccgtataagtttctttatctttaccctgcattacccacaggctggctccaccgataatggcattttgcggtgcatctttcgcatcggcgtcgtaaggcatcatgcctacgccgtagttaaatttggcgtactcgcgaatgttggcaagagaaccggaagaggcagtggtcatcgcgcaatcaccgttatagaacttctcagtggattcatccttacgcccgacgtagctgaaatcgcccttcttgttcatctcttcgagcatagtgatgtgtttcacctgctccggcttgttgaactccagcaccgcgtctgtgccgtcaaagccgttgtttttgctggcaaacggcagaccgttccaggcgctaaagttttccagttggatccagccctgccagccgctggcgtagccgcacttcataccggaggctttcagtttcgcggcatagtccgccagatcctgccaggttttcggcggctgttccgggtctaaaccggctttcttgaaggcgtctttgttgtaatagagaacgggagtcgagctgttgaacggctgggagagtaagtggccggttttgctgtcggagtagtaacctgaaaccgtcggcacaaactgcgactcatcgaactgaatccccgcctctttaaacacgtcatatactggtttaatggctttcgacgccatcatggtggcggtgccaacttcataaacctgcaaaatagcaggcgcgttgccggtacgaaatgcggcaatccccgcgcttaaattctgttcgtagttgcctttataggtcggtacaattttgtaatccgggttttcggcgttaaaacgttgggccagagaatccacctctttacccagttccccttccatagaatgccagaacggaatggtcgtcactgcctgtgcattccccattaacgccagtccgagcgccagtgctgaagctgtataatgtaacggtttcatcgtttatctctcttgttgtaccgaatgcgcgaattcacgcgttttatgctcgcggggtaacatgacatgctcgaattacagaaaaataacttttttgttacatttgtaagatagtaaggtgtcagaaagatgacaaggcggtgacggtacgggtgagggaaaatgggagatggggcacggataagcgggaaaaatagaaggtctgaatcaaactctacagattgctcatcgtttcatgccggatgcggcgtaaacgccttatccggcctacaagatcgtgcaaattcaatatattgcaactcacccagtaggcctgataagcgcagcgcatcaggcaattttacatttgtaacctgtctcaaaggagtcttttgactccttatcaatcaacgtgttattacccgcctaaatacgcacttctcaccgcttcattcgccagcagcgcgtcgccggtatcggagagcactacatgaccgttttccagcacgtagccgcgatccgccagctttagcgcctggttggcgttctgctcgacgaggaagatggtcatcccctgctcacgcagctgctcgatggtgtcgaaaatttgctggatgataatcggcgcaagaccgagcgatggctcatcaagcaacaataaacgcgggttgctcatcagcgcgcgaccaatcgccagcatctgctgctcaccgccggacatggtgcccgcccgctgaacacggcgttcatggagacgcggaaacagttcatacacccactttatgcgttcctggaactggtcacgttcagcaaaaaaaccgcccatcgccaggttctcttccaccgtcatccgcgagaaaacacgacgcccttccgggacaatcgccaccgcttcgcgcatgattttcgccgtctgccagtcggtaatgtctttatcatcaaacacaattcgcccgctggtggcgcgcgggtcgccgcataatgtgccgagcaaggtggttttccccgccccgttcgcgccaataagggtgacaatctcgccctgattgatatgcaggctcacctcatgcagcgcctggattttgccgtagtgggcgctgactttgtcaaaggacaacatgactttttccatcttatgcctcacctaaataggcacggatcacgtccgggttattacggatttgctccggcgtaccgtttgccagtggcgtcccctgattgaccacgtaaattcggtccgaaattcccatcaccagcttcatatcgtgttcaattaacaagatagtggtgttgtgatgattgcgcagttcggcaatcagctcatccagctctttcgtctctttcgggttaagacctgccgcaggttcgtcgagcattaaaatctccggctgcgtcaccatgcagcgggcaatctccagacgacgctggtcaccataggccaggttactcgcctgacggttggcatgttccagcaaaccaatgcgctcaagccaggtagcggcgcggtcgagcgcttcgctctgggcgcgacggaaagaaggcgttttcaaaaggccggagaacagcccggttttcagttgctgatgctgtgccaccagcaggttttcaattaccgtcatttcacggaacagacgcacatgctggaaggtacgcaccacgcccatgcgggcaatttgctgccccggtaaaccttccagatgctgatcgcgcagtaaaatagtgccgccggtgggtttatagaatccagtcaggcagttgaagaccgtggtttttccggcaccgttaggtccgattaacgagacgatctcctgcgggtacagttcaagattgacgttgttcaccgccagcaggccgccgaagcgcatcatcaggccgttaacggataataatggctgactcatgcctgctctcctttcgctgcgccgtttttcagcttcagttgcgggcgcgtcatgggcagcaagccctgcggacgccagatcatcatcagcaccatcaaaccaccgagcattaacatgctgtattcgttgaaatcacgcatcaattcgcgcgacaccaccagcaaaattgccgccagaattaccgcaaattgcgagcccataccgccaagcaccactatcgccagcacaaacgccgattcggcaaaggtgaaggattccgggctgacaaagccctgacgcgcagcaaacagcgttccggcaaaaccggcaaacgcagcgctaatggtaaaggcagtcagcttgatacgacgcgggcttaagcccagcgaacggcaggcgatctcgtcttcacgcaacgcttcccacgcacggcccagcggcatccgcagcaggcggttaatgacaaacaggcttaataccaccagcagcaacgccaccaggtacaggaagataacgcgatcggagggatcgtatttcaggccaaagaaattactgaacgtgtcccagccgccttcgcgggcggtacggctgaactcgaggccgaagaaagtcggtttcgggatctgactaattccgttcgggccaccagtgatttcagtgttattgagcagcaatatgcgcacaatttcgccgaaaccgagggtaacgatcgccagatagtcaccgcgcagacgcagcaccggaaagccgagcaggaagcccgccgccgccgccattaacccggcaatcggcagacaggtccagaagcccagaccgtaatagtgattgagcagcgcaaaagtgtaagcgccgatggcgtaaaagccgccgtaccccagcaccagcagaccagaaagacctaccaccacgttcagcccgaggccaaggataatgtagatcatggtcagggtggcaatatccaccgtcccgcgtgaaaccataaacggccacgccaccgcaagcaccaacagcgccacgaggaacagtttctgtttcaccgtggagccatcaatcgcgggcagaataaacttcggtccggaaacgcttttcagccctttctggaaagccggtcgcaaaagctggaagaaaaagaccaccgccgtgccgataaacacccactgccaacggatgtctgaagccgtgtcgaccaccagtttggtgccatccagctccagttgcacgcccataaagacgccagcgaggacaaagaacatcgcggcagagagcaacgccattgcaatatgcatcggtttcatactttctctacctccgggcgacccagaataccggtcggcatcaccagcaacacaagaatcagcagggcgaatgagaccacatctttatattccgtactcagataggcagaagagagcgcctccgcaatccccaggatcagcccgccaatcatcgctcccggaatgctgccaatcccaccgagcaccgcagcggtaaaggctttcatcccggccataaagccgatgtaggggttaatgacgccgtagaactgaccgagtagcacacccgccaccgccgccatcgccgcgccaatcacaaaggtcagcgcaatcacccgatcggtgttgatgccaagcaggctcgccattttcagatcttccgcgcaggcacggcaggcgcgccccatacgggaatagcgaatgaaaatcgtcagcgccagcatggcgaggaaagtaacaatccatatcaccgcctgcatggtggtaatagaggcagagaagttttcgctatggcccaccacccactgaccgttaaacagactgggcagcgccacgtcgcgcgaaccttcggtcagactgacatagttttgcaggaagatggacatgccgattgcggaaatgagcgcaatcaggcgcttagagttacgcaccgggcgataggccacccgttcgatactccagccgtaggcgctggcaatgacgattgcgccgacgaatcccgccgccaccagtagccagccggtatcaatgcccagcatcatcagtgcggcgatgatcataaaggagacatagctaccaatcatataaacctcgccgtgggcgaagttgatcatgccgataatgccgtaaaccatggtgtagccgatggctatcagcgcgtaggtactgcccagcgtgacgccgttaaacatctgctgcaagaaatacaaaaactgctcagacataaggtaacctttctaaacccgcccgtttttcacgggcggtgggatgatcacttggctgccgtggatgaaccgtcggcgtgccactggaagacaccaaaatcaaatcccttaagatcgcctttttcatcccagttcagcggcccaatcacggtgttcgcaccgttagcttttaaatctttcaccagtgccagcggctcatcgctgccggtacgctcaagggcagtcgccagagattgcaccgccgcgtaagtgatccagacataaggcccggacggatctttcttgtctgctttcaacgcatcaacaatgccctggtttgccggatcctggtcatagcgttttggcatagtgaccaacatgccttcggcagcatcgccagcaatattcgacaacgacgcattacccacaccttccggccccataaactgagttttcaggccaacggaacgggcctggcgcagcatctgccccatttccgggtagtaaccgccgtagtaaacgaagtcgatgttttcttttttcaggcgggcgatcagcgcggagaaatctttctccccggcggtaataccgtcgaagaaaacgacgttggcattggctgctttcaatccgtcctgcaccgaacgcgccagcccttcaccatactgttgtttgtcgtgaatgatcgcgatgcgctggggcttcaccgtctcaagaatgtattttgccgccgttggcccctgggaagagtccagcccggcagtgcgcatgatgtgttgataaccgcgttgggtcagctccgggttggtcgctcccggcgagatcatcagaataccttcgtcttcgtagatatctgaagcaggctgggtagaggaggaacacagatggccgatgacgtatttaatgccgtcgttaacgattttgttggcgaccgcaacggcttgtttcggatcgcaggcgtcgtcatattccacgcccaccagcttatcgcccttaattccccctttggcattaatgtctttaatggcctgacgcgcgccgttaaattccatatcgccccactgagcaatcggaccggacatcgcgccgacaacggcaactttaatatcgtcggctaaagcggtgtgtgaaattgccagtgcaatcatccctgcgatgatagttttcgcattccgtttcatagtcaaaaatccccactcgtaatgttgtgttgctttgtttttatgtgttaacaaatcaggctgttctttttttatactgcgctgtttttacctgtctgattaagggtttagcgcagtattttgtgataatagcgattaaaatccctatttttcagtcgattaagaacagataatattctgaattaattgatagataaacagaaaaaagcaccgttgtcagcataaaataacggaacaaagggcagaataattcactaccattcaggggattatgctggacatttttcattctctaatgttttaactttgtaattattgctgaaaaaaaattaatcacctgccaaaagaaataaaaaagagaaagcctccgattaaattatttcgctacactggttcctcttttgtgatttacacgggttacccatgaagctgaccatcattcgattagaaaactttagcgaccaggaccggattgacctgcaaaagatctggccggagtattccccttcctctttacaggttgacgataaccaccgtatctacgccgcgcgttttaacgagcgcctcctagcggccgtgcgggtaaccttaagcggcaccgagggggcactggattctctacgtgtgcgggaagtcacccgccgtcgcggtgtggggcaatatctgctggaagaggttttgcgtaccaatcctggcgttttaggctggtggatggcggatgctggcgtggaagatcgcggtgtgatgacagcgtttatgcaggctctgggatttacggcacaacagggcggctgggagaagcgttaatcgtcaagtttgatttcaaaagtgacgaccaacgagaaattgcctgatgcgctacgcttatcaggcctacaatgtgtgctgcaatttactgatttctttggatcttgtaggccggataaggcgtatacgccgcatccggcatgaagcaacgtactcgatattagcaatttggcggcaactccaagttgccgattaatgattacttcgcatcggtcgccgtgccgttggcgtgccagtcaaatacgccgaactcaaagcctttcagatcgcctttctcatcccaggtcagcggccccatcaccgtatccacggagttcgctttcaggtatttggcgatttcagccggatcgtcagactgattcagacccgcctgcaaagattgcagcgcggcgtaggtggtccagacgaacgcgccgcttgggtcctgtttcttcgctttgatcgcgtcaacaattggtttgttcgccggaacctgatcgtagttcttcggcttggtcaccagcagcccttccgctgattcgcccgcaatgttagacagcgagacgttagccacgccttccggccccataaactgagttttcagccccgccgcgcgtgcctgacgcaggatttgccccatttccgggtgataaccgccgtagtaaacgaagtcgatattctcttttttcagacgcgccaccagcgtagagaaatctttttccccggcggtgatgccatcaaagaacaccacgttagcattgcctttcttcaggccgtcctgcaccgcacgcgccagaccttcgccgtattgctgtttgtcgtggacgatagcaatacgctgcggtttcactttatcaagaatatatttcgccgccgtcggcccctggtcggagtccaggccggtagtgcgcaggatcagctgatagccacgagcggtcagctctggcgcggttgccgctggggtgatcattaaaatgccttcatcttcatagatgtctgacgctggctgcgttgatgaagaacagaggtgaccaatcacatatttaatgccgtcgttaacgactttgttcgccaccgcaaccgcctgtttcgggtcacaggcatcgtcatatttcacgatttgcagtttgttgcctttgataccacctttagcattgatatccgcaaccgcctgctcagcaccagtaaactcctggtcaccgtactgggccaccggaccggacattgcgcccacgaccgcgactttaatatcttctgccagagccatattgctgaatgccagcgcgatacatcctgccagtaacgctttaccctttatattcatcctgagaatccccattcttctggttattacgtgtgttgtgatgttgttgttcagcactttatttcgttttatgcatgactacccgtgctttagcagcatactctgctaaaacatacccgatttttatgatattggaatagctattttgacagtttattaacaatctgcgtggggattggcgttttgccggagggggaaactgattattgcagaggcccaaaaaacaaaaaccccggattctcatccagggttctctgcttaatagcggaaattacgcttcaatggcagcacgcaattttttcatcgcgttcttttccagctggcgcacacgctcagcggaaacaccgtaacggtcagccagttcctgcaacgtggacttgttgtcttcgtccagccagcgcgcgcggatgatatcctggctacgctcgtccagaccttgcatcgcgtcggtcagacggtttgccgcctgctcttcccagttatcatcttcaatgccgtcagcaaagttagatgatttatcctgcagatagagcaccggagccatcggctggctgtcggaatcgtcgtcggaagacaggtcaaaggtcatgtcctgtgccgccatacgcgactccatctcacgtacgtctttgctggttacgcccagttcacgggccaccatttcaacttcatcctggttaaaccagcccagacgctgcttggttttacgcaggttgaagaacagtttgcgctgcgctttggtggtcgcaactttgacgatacgccagttacgcagaacgtattcgtggatctctgctttgatccagtggacggcgaaggagaccaggcgcacacccacttccgggttaaaacggcgcactgctttcatcaggccgatgttaccttcctgaatcaaatccgcctgtggcaggccatagcccgcataattacgagcaatatgaacaacaaaccgcaggtgagacaggatcagcgttttagctgcttccagatcgccatggtaatgcagcttttcagccagcgcccgctcctcgtcagccgacaacatcggccacgcgttagctgcccggatgtaggaatccaggttgccaactggggctaaagctaaactttgcattttgtcagtcattcaaatcctctcaatcgatatcttctggcgcttcagtggtagcaacaactgtgccagagcttaagagcaacgaggttatcattcactgttttatcagaccgtgattttatccacaagttcaatgcaagcttgtgaataaattacgcacaaaatgtgacatagagatgaaataccgggaagagacaacggggtctctttccctgctacggaacccattgcagggaaagagtataacacgcttttattattcaggcgtaaagtggcgtaaatgttgtaccgtggcaagccacgctgccacccagccaatcatcgagcataccagcagcaacagcaggcattcatcgaacgataagccattgatatcaaacttcgttccgaaaacctgtgccacttctgcaaccgccgatgacaaacgcagtaccagaatttctgacaaaattaatgacagcaatgcgccagaaaatcccagcaatgcgcctccgtacaggaacgggcgcaggatgaaaccatccgtcgcaccaatcagtttttgtacgttaatggagtcacggcgagcaaagatgctcagacgcacactgttgccgatgacgaggaacactgctgccaccatcaacacgccgatcatcgcggaaacgcgcccgaccagcccggttaacgccgccagacgggcaaaccagctgtcatccatccgcacttcgtcaatgccgttgatctgggtgatacgatcacgcagcgtattcagtgattccgtcccctgaaaatcgagtttcgggatcaccaccgccactgccggaagcgggttttcttccagcatatccagcgcaccaccaaaaccagaccagttacggaactcgcccagcgcgtcttcacgagaaagatagttcactttctccacgccctgctcggcctgtagctgcgccaccacgcctgctgcggcatcatcgtccagcgttttttggagataaacggtgatttgcggtgacggataatactgcgtcgccgcctggttaacgtttttgtaaaccatatagcagacgctgggcagcgtcagggagatggcgataaccatcaccgttaaaaacgtggcgaacggtttgcttttcagatcctgcaatgcgccgtggaaggcatagcgcacctgttcgttgaaaacgttggttttgcgatttaccggttttggcgaggatttcgcgcgtttcggcgcgttacgaccgccgtcgccagagccaccgaccgatttacggaagcgatccagacgcccgccaaactgccgaatatgattgattgcatcgcgcttattcatggcccacgcctccatgcaagtgaccatcgctcagggtgagcatgcgataggaacgccgcgagatcaggttgatgtcgtgcgttgccatcaatacggttaccccaacgcggttaaactcttcaaacagacgtagaatcccttccgacaacgcgtcgtccaggttaccagttggttcgtccgccagcagtaccgcgggcttgttcaccaccgcgcgggcaatgccaacacgttgttgttcaccgccggaaagctgaataggaaagttcttcgctttgtccagtagcccgactttatccagtgccgccgacacccggcgacgaatatcgtcaccgctggcaccggcgataatcagcgggatcgccacgttatcgtagacagtacggtccatcagtagatggtgatcctggaaaatcatgccaatctggcggcgcagaaacggaacttcacggtttttcagacgcgtgatgtcatggccgctaaaccagattttcccggcgctgggccgctcaatcccacagatcagcttcaggagggtacttttccctgcgccggaatgaccggtcagaaacgccatctcacccggctgcatatggaacgtaacgccctgcagcgcctgtctcccaccgagataagccttgctgacatgttcaaagcgaatcattgttaatcctctcgggcaaaaagtgcctctataaagtcgtccgccttaaacggacgcaaatcctcaatacgttcgccgacaccaatgtagcggatagggataccaaactggtcagccaccgagaaaattaccccgcctttcgccgtgccgtccagtttcgttagcgtgatgccggttaagccaacggcttcgtgaaacagtttggcctggcttaccgcgttctgcccggtgctggcatcaatagtcagcataacctcatgcggcgcttcaacgtcgagtttcttcatcacgcggacgattttcttcaactcttccatcaggtgcgatttgttctgcaggcgtccggcggtatcggcaatcaggacgtcgatattacgcgctttagcggcctgaatggcgtcgaagataacagaggcggaatccgcaccggtatgctgggcaatcaccggaatattgttgcgctgaccccagacctgaagctgttcaaccgctgccgcacggaaagtatcgcccgccgccagcatcaccgatttaccctgctgctcaaactgacgcgccagcttaccaatcgtcgtggttttacccacaccgttgacgcctaccatcaggatcacgaacggcgttttaccttcaacattcagcggctcatcgactttcgccagaatctcgcccatctcttctttcagcaggccatagagcgcctcggcatcacgaagctgcttgcgggatgcgccttccgtcagattggtgataattttacgtgtggtttccacgcccacatcggcgatcaacagctgctcttccagctcttcaaacagatcatcgtcgatttttttaccgcggaacaggctgataaatccggaaccgaggttttctttggtttttaacaggctgcgtttcaggcgcgcgaagaaaccttctttggtcggtttttcctgctcctgagcgatttcttccaccggctgctcttcttctgccggaggaaccaccatcaccgcctcttctgccgcttcggcagccagcgcctgtgcttccagctcttcgtcggtgatttcttctttagccgcttcttcttccgccgcttcgacaatctctacggtttccgcttcggcctgccactcttctggcgaaacctcttcggcgttgacgtcttccggcaacggcagctcttcacgctcgataaccactggctccggcgtttcttctacgaccggttccggctgtgcaacgacttccgcttcaggctgcgctttttcactttcagcaacctgttcagtgacttccacaacgtcggcagcaaaagtttccgcctcggcttcagtatgcgcctgcggctgctcttcaacggcttgttcagaagccttcgcaggctcttgcgccggaacgatttcttctacaaccggttgttcattctgaacttctgtctctttttccggggtctgctctttttgaccaaagcccagccaggaaaaaaagccacgttttttttctttcgccatttgcgactacactcctcgctgttgcttcatggcacagcgttaacgctatgtacatagcagctaaaaaaatgatgaaatagtctatcacttaacttaattcacatcaccgcctgcaagtatgtgttatctggcggattgagcaatttatcatgaaaaaaccgaatcattccggcagcggccagatccgcattattggcgggcagtggcgaggccgtaaactcccggttcctgatagcccaggtctgcgccccaccacagaccgcgtacgcgaaacgttgtttaactggctggctccggtcattgttgacgcccaatgtctggattgcttcgccgggagcggcgcgctggggctggaagcgttatcgcgctacgctgcgggggccacattgattgaaatggatcgcgcggtttctcagcagttaattaagaatctggcgacactaaaagcaggcaatgcacgcgtggtgaacagcaacgcgatgtcattcctggcgcaaaaaggcacaccgcataatatcgtgtttgtcgatccaccgttccgccgtggcttgttagaagagacgataaatttactggaagataacggctggctggctgacgaagccctgatttatgtcgaaagcgaagtcgaaaacggtctgcccactgttccggcaaactggtcattacatcgggaaaaagtggcgggtcaggtggcttatcggctgtatcaacgcgaagcacaaggagaaagtgatgttgattaatattggacgtttgttaatgctctgcgtttggggatttttaatcctcaacctggtgcatcccttcccgcgtccgctgaatattttcgttaacgtggcgctgatttttaccgtgctgatgcatggtatgcaactggcgctattgaaatccactttaccgaaagatggcccgcagatgaccaccgccgaaaaggtgcggattttccttttcggcgtgtttgaactgctggtctggcagaagaaatttaaagttaaaaaataaccttattgttcgccaacaaagctgacaaagcgcgttcctttatagctcagcgtacctttatcgcccattgtcagggcgtggtactgctgggcgtcgaggcgaaacgtctgctccattcctccgctttgcggtttgaagcttgcctcatagcgcatactggtgcctgccggagtcacttcctgctggcgcgaacggcgatcgttaatcggtttttcccgcttgttgctcaccaccaccagcttttgctggagcggtgccatatcattatcagctttttcccgtcgttgttgcataaaacgaaacgatgcggcgacgatgattaagccaatgataacaataaagaaaagaggtggtttgctcatctttatccctcatcggaaaatgcggaattaagcataccctgccagttatggtgttgtcatccgtccaccctcgccactaaactggaagcaagaccgtaggcattccgcttacgaaaaaataacgaattcaaggaactaagatgctttggtcgtttatcgctgtctgtctttccgcatggctatctgtggatgcatcgtatcgtgggccaacctggcaacgctgggtgtttaaaccgttaacccttcttctcctgctgttactggcctggcaagcgccaatgttcgacgccattagctatctggtgctggcggggctgtgcgcctcactgctgggcgatgcgctaaccctgttgccacgtcaacgtctgatgtacgccatcggcgcgtttttcctctcgcacctgctgtacaccatctatttcgccagtcagatgacgctctctttcttctggcctctgccactggtgttgctggttctgggcgcgctgttactggcgattatctggacgcgtctggaagagtatcgttggcctatctgcacgtttatcggcatgacgctggtgatggtgtggctggcaggtgaactgtggttcttccgtccgaccgctccggcgctctctgcgtttgtcggcgcttcgttgctgtttatcagtaactttgtctggctgggtagtcactatcgccgacgcttccgtgcggacaacgctattgctgcggcctgctactttgccggtcatttcctcatcgttcgctcgctgtatctctgataaaacttgactctggagtcgactccagagtgtatccttcggttaatgagaaaaaacttaaccggaggatgccatgtcgactcctgacaatcacggcaagaaagcccctcactttgctgcgttcaaaccgctaaccacggcacagaacgccaacgactgttgctgcgacggcgcatgttccagcacgccaacgctctctgaaaacgtctccggcacccgctatagctggaaagtcagcggcatggactgcgccgcctgtgcgcgcaaggtagaaaatgccgtgcgccagcttgcaggcgtgaatcaggtgcaggtgttgttcgccaccgaaaaactggtggtcgatgccgacaatgacatccgtgcccaggttgaatctgcggtgcaaaaagcgggctattccctgcgcgatgaacaggccgccgacgaaccgcaagcatcacgcctgaaagagaatttgccgctgattacgcttatcgtgatgatggcggtaagttggggactggagcagtttaatcatccgttcgggcaactggcgtttatcgcgaccacgctggttggactgtacccgattgctcgtcaggcattacggctgatcaaatccggcagctacttcgctattgaaaccttaatgagcgtagccgctattggtgcgctgtttattggcgcaacggctgaagctgcgatggtgttgctgctgtttttgattggtgaacgactggaaggctgggccgccagccgcgcgcgtcagggcgttagcgcgttaatggcactgaaaccagaaaccgccacgcgcctgcgtaacggtgagcgtgaagaggtggcgattaacagcctgcgccctggcgatgtgattgaagttgccgcaggcgggcgtttgcctgccgacggtaaactgctctcaccgtttgccagttttgatgaaagcgccctgaccggcgaatccattccggtggagcgcgcgacgggtgataaagttcctgcaggagccaccagcgtagaccgtctggtaacgctggaagtgctgtcagaaccgggtgccagcgccattgaccggattctgaaactgatcgaagaagccgaagagcgtcgcgcacccattgagcggtttatcgaccgtttcagccgtatctacacgcccgcgattatggccgtcgccctgctggtaacgctggtgccgccgctgctgtttgcggccagctggcaagagtggatttataaagggctgacgctgctgctgattggttgcccgtgtgcgttagttatctcaacgcctgcggcgataacctccgggctggcagcagcagcgcgtcgtggggcgttgattaaaggcggtgcggcgctggaacaactaggtcgtgttacccaggtggcgtttgataaaaccggtacgctgaccgtcggtaaaccgcgcgttaccgcgattcatccggcaacgggtattagtgaatctgaactgctgacactggcagcggcggtcgagcaaggcgcgacgcatccactggcgcaagccatcgtacgcgaagcacaggttgctgaactcgccattcccgccgccgaatcacagcgggcgctggtcgggtctggcattgaagcgcaggttaacggtgagcgcgtgttgatatgcgctgccggaaaacatccggctgttgcatttgctggtttgattaatgaactggaaagcgccgggcaaacggtagtgctggtagtgcgtaacgatgacgtgcttggcgtaattgcattgcaggataccctgcgcgccgatgctgcaactgccatcagtgaactgaacgcgctgggcgtcaaaggggtgatcctcaccggcgataatccacgcgcagcggcggcaattgccggggaactggggctggagtttaaagcgggcctgttgccggaagataaagtcaaagcggtgaccgagctgaatcaacatgcgccgctggcgatggtcggtgacggtattaacgacgcgccagcgatgaaagccgccaccattgggattgcaatgggcagtggcacagacgtggcgctggaaaccgccgatgcagcattaacccataaccacctgcgcggcctggtgcaaatgattgaactggcacgcgccactcacgccaatatccgccagaacatcaccattgcgctggggctgaaagggatcttcctcgtcaccacgctgttagggatgaccggactatggctggcggtgctggcagatacgggtgcgacggtgctggtgacagcgaatgcgttaaggctgttgcgcaggaagtaaaagtgttgcctgatagcctctggctatcaggcttagtgctgaggcgggaacggcggcatagtcaggaaagcataataaagcgctaacatcagaatgacagagacaacacagcatgcagcaaccaggcgggatgctatagatggccttttgaacatcaaccacagggcataagcaagcccgacaccgttaagtaaaggtaaaaaaatcattagccagagccaaccccaggcaagtacccccagccatccccccacgacgataaaaacagggatcagccaattgggggtgaagatcgcgagtaatcccagcaatgccagacaaactggaattaaataatccatttgtgcattccattacacttgcttgccggatgcggcgtaaacgccttatccagcctacacagggcatcgaactcgtagccatgataaaacgcgacagcgtcgcatcaggcattgcgcaccgtatcgccagatgcagcttgaacgttttatccgtcctacaaaccggttgcaagccgcaaaattgagcgcgatcggtccgctagcctgatccaccttaccccgatttgcgaatcaaataacgataaggcagttcatccgtctctttagcaaccagctcatgttccataaaggtacaaaacccaggaatatcgcgggtcgtcgccggatcgtcagcaataatcagcaacgtttcacctggctgcatattgcgcacagttttgcgcaccatcattactggttccgggcagcgcaggccaagcgcgtcgagtgtgtggtcagggctggaaaagagatcggtcattttcttctcatcacataaaaaaacggcgctagtttacgccctgtgagtccgtaagcaaaccaggttaacgattgcgtgaaaattaaccattgcattgtcaacgtaaagcagtatcatgcggcggctcgaaaaaagggtcagcacgttattatgttaaggtaacagacgtgtcgtacgtattgggttccctcaccccaatggttaatcaaaaaggtacaatatgaacgttttctcgcaaactcaacgctataaggcgttgttctggttatcgttatttcatcttttggtgatcacctccagtaactatctggttcagcttcccgtctccatttttggtttccataccacctggggcgcgtttagctttccgtttattttccttgctaccgacctgaccgtgcgtatttttggcgcaccgctggcccgtcgtatcatctttgcggtgatgatcccggcgttactgatctcctacgtcatctcgtcgctgttctatatgggttcctggcagggattcggcgcgctcgcccacttcaacctgtttgtcgcccgtatcgccaccgccagtttcatggcctacgcgctggggcaaatcctcgacgtgcacgtttttaaccgcctgcgtcagagtcgccgctggtggctggcaccgacggcttccacactgttcggtaacgtcagcgacacgctggcctttttcttcattgccttctggcgtagcccggatgcctttatggctgaacactggatggaaatcgcgctggtcgattactgtttcaaagtgttaatcagtatcgttttcttcctaccaatgtatggcgtattactcaatatgctgttgaaaagactggcagataaatccgaaatcaacgctttgcaggcgagttaaaggttcgttatcagagttgtgataagatggatgaatgagccgttatggccgtttatcgaaaggaagaagtcaatgcgcaatctggttaaatatgtcggaattggcctgctggttatggggcttgcggcctgtgatgataaagacactaacgctacggcgcagggttcggtcgcggaaagtaacgctaccgggaatcccgtcaacctgcttgatggcaagttaagtttctcgctgccagcggatatgaccgaccagagcggtaagctgggaacgcaggctaataacatgcatgtctggtccgacgccaccgggcaaaaagcagtcatcgtcatcatgggcgatgatccgaaagaagatctggcggtgctggcgaagcgcctggaagatcagcaacgtagccgcgatccgcagctgcaagtggtaaccaataaagccattgagctgaaaggtcacaaaatgcagcagttagacagcattatctccgcgaaaggccagacggcgtactcttccgttattctgggtaacgtgggtaatcaactgctgaccatgcaaattacgctgccagctgacgatcagcaaaaagcacagaccaccgcagaaaacatcattaatacgctggttattcagtaagttttaagatgatgagatggcctcaggaacttccaccggaggccgtttttttaatcgccacgtcagtaataacgcgattgcgaccagtcccgccgccgccagataaatcaccgggacgcccgcccagctcatcaccagcccagccagtggtccggtcacgccaagcgataaatccataaatacggtgtaagttgccagcgccgccccctgattttgctgcggaaccgcttttaccgccactacgcccaatgccgggaacaccagtgaaaacccggcccccgccagcaagacgccgattttcgccatccacggcatagtcgccacgccaaccagtagcaggccgattatctcaacgctaaagcaaatcatcgctacgtttaagccgccgatacggttaatgccgttagggaataacaaacgcgtaccgacaaacgcacagctaaacagcgtcagcgcgaaagccgcaccgtcccaacctttagcgtcataaaacagcgtgataaaggtggcaataacgccaaatccggcggaagccagtgccagcgccataccgtacagccagacgcgcccaagcaccgcgcgaaacggcagcggtttgcctttactggcttttaccgtcggacgcgggatcgccaacaaaatggccaccagcgccacgcccataatgattaacgctaacgcctgcaagccgccccagtgataaaacacgacacctaacggcgcacccatcgccatcgccccgtaagtgacaatgccgttccacgaaatcacccgtccgatatgcagcgagccaaccacgccaacgccccacagggtcgatcccgttccggcaaaactttgcccaatcccaaggatgacgcgccccaggcaaagtaataacaggctgatgacgggcagactggcggttaatcctgccgtcagataccccagaccgctcaaaaagcagccgcacaaaccgaagacgacaatctttttgggccccagcaaatcggcgtaacgtccggcatgaggacggctcagcaaggtggcgaaatattgcaggctgataaccaatcctgcccagaaagcgctaaagcccatcacatcatggacatagcccggtaatacagcgagcggtaacccgatggtgaggtagctggcgaagttaaacatgactatagagacaatgcgcaaattcaggcgcaatccgtttagcgcgggttcggctacgggttcgggcatgaggatcaccacatttttacaacagtgtttcatttttaccacgtgctgacgtgaaaatcagcagtaagaatcagaatattgctggcgtgactcccgctacacttaatacaaaaagtcacaaggaagccccaatggaaacccctcaacccgataaaacgggcatgcacattctgctcaagctggcctcgctggtagtgatcctcgcgggcattcacgcagcggcagatatcattgtgcagctgttactggcgctgttttttgccatcgtcctcaacccgctcgtcacctggtttattcgtcggggagtacaacgccccgttgccattacgattgtggtggtggtgatgctgatcgcactaactgcgctggtcggcgtactggcggcatcgtttaacgaatttatctctatgctgccgaagtttaataaggagctaacgcgcaaactttttaaattgcaggagatgttgccttttcttaatttgcatatgtcaccggagcgaatgctgcagcggatggactcggaaaaagtggttaccttcaccacggcgctaatgaccgggctttccggggcaatggcgagcgtgcttttgctggtgatgaccgtagttttcatgctgtttgaagtgcgccacgtcccttacaaaatgcgttttgcgttgaataatccacagattcacatcgccggactacaccgcgccttaaaaggtgtttcgcattatctggcgttaaagacgctgctaagtttatggacaggcgtaatcgtctggctggggctggcgctaatgggcgtacagtttgcgctgatgtgggcagtactggcgtttttgctcaactacgtgcccaatatcggcgcggtaatttccgccgtaccgccaatgattcaggtgctgctgtttaatggcgtttacgaatgtattctggtcggcgcattgtttttagtggtccatatggtcatcggcaatattttagaaccacggatgatgggccatcgcctggggatgtccaccatggtggtatttctttcattgttaatttggggatggctgctcggcccggtagggatgctactttcggtaccattaaccagcgtgtgtaaaatctggatggaaaccaccaaaggcggtagcaaactggcgattttactgggaccgggcagaccgaaaagtcgattaccgggttaatagcacctcctgagcaggcaatggccaccgtttatctaacagtggccatttgatttgaggaaatgaagaaacattattcagacaattaatttataaaaaccattccttaagtcaaatatatataaacgccgaatagcgattaaatccttctcaaagaatgcactgataacattgtgttatttttattgcctcatttttctcactcacttatagttggtccccgctggcagtaatttagtcatttcagaaatttttactctgatgtgcacttactgacttatctcacaagtaattttttcgctaaataaagaatagtgatgccagcaattacagttaaatcttgctttactcgtaaaaacaatactttaatggggttctaatgagacattacatgaaatggtttgcggctattgctgttgtgggtgctttagcgggttgcgcgcgtactgcgccaattgatcaggttcactcaaccgtcagcgctggtcatacccaggaacaagtgaaaaaagcgattctgaaagctggcgttgaacgcaaatggattatgtccgaagccggacaaggcgtaattaaagcacgtcaacagtcacgcgatcattcagccgaaattcgcattaactacacggcatccagctacgatatcaattatgaaaatagccagaacctacaagcgtcaggcggacaaattcataaaaactacaatcgctgggtccgcaatctcgacaaagatattcaactgaatttgtcagcgggcgcagatttataattcttcctaaagtcgggccgctgcggtccgataataatttaattccctcttaacaggttgtgcccaacatgtacgaacaggattctcttagcgcactggatgcgattaccgaagctcaacgcattgcctttgcccctatgctttttcaaacagcactctgcctacgtaatgcgggtgtactttcatatctggatcggcaaggcaaacatggcgcaacgctggctgatatcaccgaacatagccatatcaacgaatatgcggccagcgttctgttagatatgggcttaagcgggcgaattattacctgtaaagagggaatgtattacctggcgaaaatcggtcattacctcctgcatgacactatgactcgcgtgaatatggatttcacccaggatgtctgttaccaggggctcttcttcctcgccgattcactcaatgaaggaaaaccgtccgggttaaaagtatttggcgactggtcgacgatatatccggcactttcacaattaccagacgccgctcgtgaaagctggtttgcgtttgatcattactattcagatggcgcatttaacgccgcactgccttatgtattcgccaacaaccccacaacattgtacgatgtaggcggcaatacgggtaagtgggctttgcgttgctgcaaatacaatgaaaacatcgccgtgacgttattagatctgccacaacaaatcgtactagcgaaagaaaatatcgcgaatgcaggtttttctgatcgcatagatttccatgcggtggatatgctaagcgatgccccattaccgggcgaggctgatatctggtggatgagccaatttttagactgtttttcacccgaacaaataattagcatactcagcaaaatcgccagcgtaatgaagcctggcgcaaaagtttgcatcatggagttgttctgggatgcgcagcggtttgaagcagcatcatttagcctgaacgcgtcctcactttattttacctgcatggcaaacggtaacagccgtttctatagtgcagagaaattttacgactatctgaataaagcaggattccaggtagcagagcgccacgataatttaggcgttgggcatacacttttgatatgccaaaagaaataatcgtcacttaataattttggtttaccgcgggcgcgcgttgatgaaatttacattaaatattaccgactggcaggcactggcgcctggacttagcgaagcgcagcaatggcaagcatggtcgcgccagccgtgggcgattgaccctgccgcgccgttggcaaaattaagtgaactgccaatgatgaccgcccgccgccttagttcaggcagcaaactggctgttgaatgcggtctggcaatgctacgccgccatcagccagacgccgttttgtataccagtcgtcatggcgaactggagcgcaattaccgcattgttcatgcactggcaaccgaacaggcgctttctccgaccgacttcgcgctctccgtacacaactcttccgtgggtaacctgaccattgcggccaaacagccgatagtttcgtcatcgctttctgctggtcgcgacactttccagcaaggtttgtgtgaagtgcttagcctgttacaagcgggataccagcgcgtgttgatggtcgattttgacggttttctgcccgagttttatcacccacaactgccatcagaaatgccgacctggccgtacgccgtcgcgctggtgattgaatctggcgatgactggcaatgtgaaacgcagtcagccattgcgggcaatgaaacatcactgccgcaaagcatgttgtttttacagcattatttacaaaatgcagacgcattttcactgcctggcgagcgcgtgcaatggcgctggagccgcagatgagtaagctgatgtcacgtctggagtggacctggcgactggtcatgaccgggttatgttttgccctgtttggtctcggcggcctgctgctttctgtcgtgtggtttaacatattgttagttttggtgtgggatacttcccgccgccgtcgtttggcgcgtcgcagcattgccgccagttttcgcctgtttttaactgtcgcgaaagggcttggcgtgctggattatcgtattgatggcgctgaaattttacgtcaggaacgcggttgcctcgtcgtagccaatcatcccacgctgatcgattacgtgctgctggcgtcagtcatgccagaaactgactgcctggtgaaaagcgcgctgttaaaaaatccttttcttggcggcgtcgtgcgggcggcagattatttaatcaacagcgaagctgaaaccctgttaccccgctgccaacagcgactggcacagggtgacactatcctgattttccccgaaggcacgcgaacgaagcccggtgaaaaaatgacgctgcagcgcggggcggcgaatattgccgtgcgctgtgccagcgatttacgcatcgtgacgatcggctgtagcgagcatctgctggataaacaaagtaaatggtatgacgttccacctgaccggccgttttttacggttgaagtccatggtcgggttgaaatcaataaattttacgatgcaacttcacaagaaccggcgctggcagcaaggcagttaaaccggcatcttttgcttctattacaacaaggttgtttacctctctcaggaataaataatgcaagcgctttatctggaaattaaaaacctcatcatcagcaccctcaatctggacgagttgactcctgatgatatcgagaccgatgcgccgctgttcggcgacggtttaggactggattccatcgatgccctggaactgggactggcagtaaaaaatgagtacggcgtggtgctctcagccgaaagcgaagagatgcgtcagcactttttctccgtcgccactctggcctctttcattgctgcgcaacgcgcctgaggaaagccatcatgacagaacaacaaaccgtctatcaggaagtctcagccctgctggttaagctgtttgaaatcgatccgcaggacatcaaacctgaagcgcgcctgtacgaagatctggaactggacagcatcgacgccgttgacatgattgtgcacctgcaaaagaaaaccggtaagaaaatcaagccggaagagtttaaagcagtgcgcacagttcaggatgtcgtagaggctgtagaacgcctgctacaagaagcctgatctgatgtcgggcattcgctcgctaccgatgattaagctgctgactggattattgctgctcgcctggccgtttgtgatttggtttggcctggcgcataacggcctgcactggttgttgccgctaatagcgttgctgctattgttgcgcctgcgccagacccgtcgccgggcggggccgctacaagccgtcacacaaatcgtcgctgtcgtgggcatcgcattgtgtgtcgccagctttctgttgaaaacgcaccagctactgctgttttacccggtagtggttaacgcgatcatgctggcggtttttggcggttcgctgtggtcgacaatgccgatagttgagcggctggcacgtttgcaggagccagacctcccggaaaagggcgtgcgctatacccgccgtgtcacgcaaatctggtgcggctttttcatcattaacggcggaattgccctctttaccgcgctttatggcgatatgtcgttatggaccgcctggaacggcatgattgcttattttttgatgggaacgttaatggcaggtgaatggctggtgcgccgtcaggtgataaaaagagatcgctcatgaagcagaccttaccgcttgcacgctggctgactgcgccacgccctgatgacacgcccattgcgtggctggacgaaagctcgtggacactgggcgatttgcgtcacgatgtcgcgcaacttatctgccgcttgcagcaacagccgggtgaacgctgggcgctgtgctttgagaacagttatttgtttatcgttgccctgcttgccacgctacacgccggaaaaacgccggtgcttccggggcataaccgtgtcatccagcttaatgaacaacgtgaactgttcgatggtgtacttagcgacagcgatcttaactggcaaggttcattgctgttggtagcaagttccccacaagtcgcgacacaatcattcacctttgccgctatagcgccagacgcttatatcgagctatttacctccggttctacggggcagccaaagcgggtaattaaacctgttcatttgctggaccgtgaagcagaactgctggctgaacgattaggcgcacgtcttgccggatgtcgtgtcgtcggttccgtattgccgcagcatctgtacggcctgacttttcgcgttttcctgccaatggcgctgggattaccgctgcacgccgccatgctctggtatgtcgaacagtttgccgcattgagtcaccagcatcgctatatcttcatcagcagcccggcatttttgaaacggctggatacccagctttctccgccgcccgttcaggtgcttctctctgctggcggtgagctgccgtggcaggacgtaaaacacaccgcgagctggctgcgcgtctggcctgatgaaatctacggcagcacggaaaccggcgtcattgcctggcgttaccgcgaacaagagcaacgccgctggctgccctttccaggtatgcacttccaggccgaaggtgaagcatttcgtctcttttcaccgctgatagcggaagataacggcctgttactcgatgatctcttgcagtttagccaggacggtcagttccatctgatggggcgtcgtgggcgcatcgttaagattgaagaaaaacgtatttctctgcaggaagtagaacaacgtctgctggcgctggacggcattcgcgaggcggcggcagttcccgttacgcgcggcgggcgtcagagcatcggcgttttgctggtgctggatgacgaagctcgcctgcaatggcagaacggcggcgggcatagccaggaaatgacctggcggcgattactgcgcccgacgctggagccagttgctattccgcgttactggcgcgttattgatgaaatgccagtaaacagtatgaacaagcgtgtctatgcgcaattacaggagttatttcatgaagccccatgaaatcgagcgccatcaggcacaagcgaatcaccttgagattgttttgcatctcagggcagatctgttctggtttcgcggccattttgccgtgcagccgttactcccaggagttgcacaaatcgactgggcgatgagctacgcgctcactctgctcgcgcctggctggcgttttcactctattcagaacatcaaattccagtccccgttgctgccggacaaccgcgtcacgctcacgcttaactggcaggaagaacgccagattctgagctttagctatcagcgtcacgacggtgacgcccgccacaccgccagtagcgggaagatccgcctatgtcggtaaacttttctccctgcgtgttgatcccctgctacaaccacggcgcgatgatgccgggcgtgctggcgcgtcttaagccatttaatctgccctgtattgtagtggatgacggcagcgatgccgccacgcaacagcaactggataatctggttgccgaacagcctggcgtgaccttaattcgcctggcagaaaacgcaggcaaaggcgcggcagtgatgcgtggcttacaggcagcggcagacgcgggcttcagccatgcggtgcaggtggatgctgacggtcagcacgcgattgaagacatccctaaactgctggcactcgctgaacagcagcctgcggcgctgatctccggccagccgatttacgatgactccatcccccgctcacggctgtacgggcgctgggtcacccacgtgtgggtatggatcgaaacgctctccctgcaactgaaagacagtatgtgcggctttcgcgtttatccggttgcgccaacgctgcaactggcaaaatacgctaccatcggcaagcggatggattttgacaccgaagtgatggtgcgcctctactggcagggaaataccagttatttcgtgccgacccgcgtcacctatccgctggacgggctttcgcattttgatgccctgaaagataacgtccgcatctcgctgatgcacacacgtctgtttttcggcatgttgccgcgtattccttcactgctgatgcgccactcttccagccactgggcgcggcagagcgaagtgaaagggttatggggaatgcgcctgatgctgctggtctggcgtctgctgggaagaactgcgtttaccgcgctgctttacccggtggtgggcgtctactggctcaccgctgctcgtgcacgtaaagcgtcgcaagactggctcgcccgtgtgcgccaacaacaaccacaggcagcaaaactcaacagctatcagcattttctacgtttcggcaacgccatgctcgacaaaatcgccagctggcgcggcgagctgcaactcgggcgtgatgtgctgtttgcaccaggcgcagaagcggcacttaacgtcagcgatccgcgcggcaaattgctgctggcctcgcatcttggcgatgtggaagtgtgccgggcgctggcaaaaattcagggctacaaaaccattaacgcgctggtgtttagcgaaaacgcccaacgctttaaacagataatgcaggagatggccccgcaggcaggcatcaacctgctcccggtaacagatatcggcccggaaaccgccatcctgctgaaagagaagctggataacggcgaatgggtggcgattgtcggtgaccgcatcgccgtcaacccgcaacgcggcggcgactggcgcgtctgctggagtccgtttatgggccagcctgcgcctttcccacaggggccgtttattcttgcgtctattttgcgctgcccggtgaatctgattttcgccctgcgccagcacggcaagctgcatattcactgcgaaacctttgccgacccgctgctgttgccgcgtggcgaacgccagcaggcgctgcaaaacgctatcgatcattacgccgcgcgtctggaacattacgcgctccagtcgcccctcgactggtttaattttttcgatttctggcaactgccggaagtccaggacaaggagtaaagggtgcttaacgatccccgatttaccgctgaagtcgagctgaccattccctttcacgacgtcgatatgatgggcgtggcctggcacggtaactattttcgctactttgaagtggcccgcgaggcgctgctcaaccagttcaattacggctatcggcagatgaaagagtccggttatttgtggccagtggtcgatgcgcgggtgaaatatcgccacgccctcacctttgagcaacgcatccgcgtgcgtgcacatatcgaagagttcgaaaaccgtctgcggattggctatcagattttcgatgccgaaacgggcaaacgcgccaccaccggatacaccattcaggtcgcggtcgacgagcaaagccgcgaactgtgctttgtcagccccgatattttgtttgaacgcatgggagtcaaaccatgaaatttttaccactgctggcgctgctgattagcccgtttgtgagcgccctgaacctggacgatcttcagcaacgctttaccgaacagccggtgatccgcgctcatttcgatcaaacccggacgattaaagatctgccgcagccgctacgatctcagggccagatgttgatcgcccgcgaccaggggctgttgtgggatcaaacctcaccatttcccatgcaactattgctggacgataaacgcatggtgcaggtgatcaacggtcagccgccgcaaatcatcacggcagaaaataacccgcagatgttccagtttaaccacctgctgcgcgcgctgttccaggccgatcgcaaagtgctggaacaaaatttccgcgtcgaatttgctgacaaaggcgaaggccgctggacactgcgcctgacgccgaccaccacgccgctggataaaattttcaacaccatcgatctcgccgggcaaacctatctggagagcattcagcttaatgataaacagggcgatcgcaccgatatcgctcttacccaacatcaactgacgccagcgcaactgaccgatgacgaacgccaacgttttgccgcccagtaaacgcccggcgctgttatgggggatcgtctgcctggtcatggcggcggcgttgctgatcctgttgccgcaatcacgactgaacagtagcgtgctggctatgttacccaaacaggcgatgggcgatattcctccagcgctgaatgacggctttatgcagcgtctggaccgccaactggtgtggctggtcagccccggtaaagaggctaatcccagggtggctcaggagtggctgacgctgctgcaaaaatccgctgcgctcggcgacgttaaagggccaatggatgccgccagccagcaggcgtggggagcgtttttctggcagcaccgcaacggcctggttgaccccgacacccgcgcgcgcctgcaaaacggcggcgaagcgcaggcgcagtggatcctctcccagctttattctgcgttctccggggtaagcggtaaggagctgcaaaacgatccgctgatgttaatgcgtggctcgcagctggcgatggcgaaaaacggccagcgtttgcggctgatggacggctggctggtgacgcaggatccccagggcaactactggtatctgctgcacggcgaactggcgggatcgtcgtttgatatgcagcaaacccaccagctcatcacgaccctgaatacgctggaaaaggatctgaaaacgcgttacccgcaggcgcagttgctctcgcgcggcacggtgttttacagcgattacgccagccaacaggcgaagcaggatatctccaacctgggcgtggcaacgctgctgggggtgatattactgattgtggcggtgttccgctctttacgcccattgctgctttgcgtgatttccatcggcatcggcgcgctggcgggaacggtcgccaccttgttgattttcggcgaattacacctgatgacgctggtgatgagcatgagcgttatcggcatttccgctgactacacgctctattacctcaccgagcggatggtgcacggcaatgacgtttcgccgtggcaaagcctggcgaaagtgcgcaatgccctgctgctggcgctgctcaccaccgtggcggcgtatctgattatgatgctcgcccccttccccggcattcgccagatggcgatttttgccgccgtcgggttgagcgcctcctgtctgaccgtcctgttctggcatccgtggctgtgccgtggcctgccggtgcgtccggttccggcgatggcgctgatgctgcgctggctggctgcgtggcggcgtaataaaaaactgtcgctgggtctgcccgtcgcgctggcgctgttttcgctggcggggatgtcaatgctgcgcgtcgacgacgatatctcgcagttacaggcgctaccgcagcatattctggcccaggagaaagccattaccgccctgaccggacaaagcgtcgatcaaaaatggtttgtagtttacggcgactctccacagcaaacattgcggcggctggagaaatttaccgcctcgctggagaatgcgaaaaaagaggggcttatcagcaactaccgcaccattccgctgaactccctggcgcggcaggaggaagatttacatctgctgaaaacggctgccccgacagtaacaaaagcactgcaaaatgccgggctggcggcagtgaatccggatctcaacgccatgccagtgaaggtcgatgaatggctggcaagccccgccagtgaaggctggcgtctgctgtggctgacgctgaaaaacggcgaaagcggcgtactggtgccggttgaaggggttaaaagtagcgcgttgttgcaggaaatcgccagcgattaccctggcggcattgcctgggttgatcgcaaaagcacctttgatgagttgttcgcactttaccgctacgtcttaaccggtttgttgctggtggcgctggcggtgattgcctgcggcgcagtggcccgcctcggctggcgcaaagggcttatcagcctggtgccttcggtactttcgctgggctgcggtctggcagtgctggcgatgagcgggcaggcggtgaatctcttttcgctactggcgctggtgctggtgcttggcatcggcatcaattacacgctgtttttcagtaatccgcgcggtacaccgttaacttccctactggcgatcacgctggcaatgctcaccaccttgctggcgctgggaatgctggtattcagcgccacccaggccatcagcagttttggcattgtgctggtgagcggtattttcaccgccttcctgctttcgccgctggctatgcccgataaaaagagaacaaaaaaatgatcaaacccacattctggcgagcgttcgccctgaccgctacgcttatcctcaccggctgtagccactcgcaaccggaacaggaaggtcgcccacaggcgtggctgcaacctggcacgcgcatcacgctgccggcaccagggatttcgcccgccgttaattcccagcaactattgagcggcagcttcaacggcaaaacccagtctctgctagtgatgcttaacgccgacgaccagaaaatcacccttgccgggctgtcgtcggtcggcattcgtctgtttctggtgacctacgatgcgcaagggctacgcgccgagcaatccatcgtcgtcccacagttgccgcccgcaagtcaggtgctggctgacgtgatgcttagccactggccgattagcgcctggcaaccgcaactccccgctggatggacgcttcgcgacaacggtgacaaacgcgaactgcgtaacgccagcggcaaactggtcacggaaatcacctatctgaatcgccagggaaaacgcgtgccaatcagcattgaacagcatgtctttaaataccacatcaccattcaatatttaggtgactgatatgatttacatttccgccgtcggcatgatcaacgccctgggaaataaccttgacgatatcgcagccaacctgactcgcggtgtcgctcccggcatgcgcccgcgcgcaggctggttgcaggggcatccgcaggcggtcctggctggcgtggatggcgagcttccggttatcccggaaaaattcgctgcgcaccgctcgcgcaacaatcagatcctgctggcggcgctggcgcagatccagccgcaggttgatgacgctattgcgaaatatggccgcgagcgcatcgcgattgtgcttggcaccagcacctccggcctgcatgaaggcgacacgcacgttaacctgcgcacccacgggcagccgagcaccacgtggcactatgcacaacaagagctcggcgatccgtcgcgttttctcagccactggctggcgctcgacggcccagcttataccctttcaaccgcctgctcctccagtgccagagcgatgatcagcgggcgcaggcttatcgaggcggggctggtcgatgccgccattgtgggtggtgcagacaccctgagccgaatgccgattaacggttttcacagcctcgaatcgctctcgccaaccttatgtcagccgtttggtcgtgaccgcgcgggcatcaccattggcgaaggtgcggggctgatgctgttgacccgcgaaccgcagcccatcgccttgctgggcgtcggtgaatcgagcgacgcttatcatatttcggccccgcatccacagggcgaaggcgcaattcgcgccattaaccaggcgctggctgatgcgcagcttacgccggatgaggtgggctatatcaacctgcacggcaccgccacacaactcaacgaccagattgaatcgatggtggtaaacgccctgtttggcgaacgcgtaccgtgcagctccaccaaacatttgaccggacacacgctgggcgcagcgggcattaccgaagcggcaatcagtatgttgatcttagagcgtgatttaccgctgcccgctcaggacttcagcctgtcgccgcgcgatcccacgctgccaccgtgcggcattatcgaacaaccacagccgctggcacgtccggtgatcctgtccaattccttcgcctttggcggcaataacgccagcattctgctcgggagggtttcgtgagccactatttatcccccggcgcttatctgccccacgacgcgcccatgttactgctggaagaagtggtgagcgtcagcgatgacagcgcggtgtgccgtgtaacggtctcgcccagtggcgtactggcaccgtttctcgacccggacggcaatctccctggctggtttgcccttgaattgatggcgcaaaccgtcggcgtctggtctggctggcatcgccaccagcagggcaaaaacagtattgagttagggatggtactgggcgcacgtgaattgctttgcgccgctggcattctgcccgcaggccagacgctgaccattaccgtcaaactcctgatgcaagacgatcgcttcggcagttttgagtgcagcatcaacaacggcacggcaacgggccgcattaacaccttccagccgaccgcggaagaacttaccaccctgtttcaacaaggagcgtcctgatgagtcgttcagttctggttactggtgccagcaaaggcattggtcgcgccatcgcctgccaactggcggcagacggctttaatattggcgttcactatcaccgtgacgccacaggcgctcaggaaacgctaaatgccattgtcgccaacgggggtaacgggcgtttgctcagtttcgacgtcgcaaaccgcgaacagtgtcgggaagtgctggagcacgaaatcgcgcaaaacggtgcctggtacggcgtggttagtaacgccgggatcgcccgcgatgccgcttttccggctttaagcgatgacgactgggatgcggtgatccacaccaatctcgacagtttctacaacgttattcagccgtgcattatgccgatgatcggcacacgccagggtggacgcatcatcacgctgtcctcggtttccggcgtgatgggcaatcgcggacaggtgaactacagcgctgccaaagccggaattatcggcgcaacaaaagcactggctatcgaactcgcgaagcgcaaaatcaccgtcaactgcatcgcgccggggcttattgataccgggatgatcgaaatggaagagagcgccctgaaagaggcaatgtcgatgatccccatgaaacgcatgggccaggcggaagaagttgccgggcttgccagctatttaatgtctgatattgcgggttacgtcacccgccaggttatttccatcaacggagggatgttatgacacgtcgcgtagtgattacaggaatgggcggcgtgactgcctttggtgaaaactggcaggacgtttccgcgcgtctgctggcgtatgagaatgcagtgcgcaaaatgccggagtggcaggtctacgatggtctgcacaccctgcttggcgcgcctgttgatgatttcacgctaccggagcactacacccgcaagcgtatccgtgcgatgggccgcgtgtcgcaaatgtcgacccgtgccagcgagctggcgttagagcaggcaggattgattggcgatccgatattaaccagcggcgaaacgggcattgcgtacggttcatcgaccggcagtaccggtccggtgagcgaatttgccaccatgctgacggaaaagcacaccaataacatcaccggcaccacctatgtacagatgatgccgcacaccaccgccgttaataccggtctgtttttcggcctgcgcgggcgggtgatcccgacctccagcgcctgtacctccggcagccaggcgatcggttatgcgtgggaagccattcgccacggttatcaaacggtgatggttgctggtggtgccgaagagttatgcccttcagaagcagcggtatttgatacacttttcgccaccagccagcacaatgatgcgccgaaaaccacaccttcaccgttcgatgaaaaccgcgacgggctggtgattggtgaaggcgcaggtacgctgattcttgaagaactggagcacgccaaagcgcgcggcgcgaccatttacggtgaaatcgtcggctttgcgactaactgcgacgcggcacatattacccagcctcagcgtgagaccatgcaatattgtatggaaaaatcgttaaaaatcgccgggttaagtgcaagtgatatcggctatatttcggcgcatggtacggcgaccgatcgtggtgatatggcagaaagtctggcgacagcaaccatttacggtgataatgtgccgctctcctcgctgaaaagttattttggtcatacgcttggtgcctgtggcgcgctcgaagcctggatgagtctgcaaatgatgcgcgaaggttggtttgcgcctacgctaaacctgaataaaccagacccgaactgtggcgcgctggattacatcatgcatgaagcccgcaaggttgattgtgagtttttgcagagtaacaactttgcctttggcggcattaatacatccatcatcattaaacgttggccctgatatgtatcggatagttctggggaaagtttcgaccttaagcgcagctccactgccaccggctttacgcgatcaagcaccgcaaggtccacgacgcgaacgctggctggcggggcgtgcattactttcgcacacgctttccccgctaccggagatcatctatggcgaacaaggcaaaccggcattcgcgccggaaacgccgctatggttcaacttaagccatagcggtgacgatatcgccctgctgttgagcgatgaaggcgaagtcggctgcgatatcgaagtgattcgcccgcgcgccaactggcgctggctggcgaacgccgtgttcagcctcggggaacacgctgagatggacgccgtgcatcccgatcagcaactggaaatgttctggcgcatctggacgcgcaaagaagccatcgttaaacagcgtggcggcagcgcctggcaaatcgtcagcgtagacagcacctatcactcatcactgtcagtcagccattgtcagctagaaaatttaagcctggcgatctgcacccctaccccctttacgctctccgccgacagtgtgcaatggatcgattcagttaactgatccgcccacccgactgcccatctattgatccagaacaggtaatcagtatgacgaatacttaaaatcgtcatacttatttccgccatctattttaatccattggggttaccatgttctctacactccgccgcactctatttgcgctgctggcttgtgcgtcttttatcgtccatgccgctgcaccagatgaaatcaccaccgcctggccggtgaatgtcgggccactaaacccgcacctttacacgcctaaccagatgttcgcccagagcatggtttatgaaccattggtgaaatatcaggcagacggttcggtgatcccgtggctggcaaaaagctggactcattctgaagatggcaaaacctggaccttcaccctgcgtgatgacgtgaaattctccaacggcgaaccgtttgatgcagaggcggcggcagaaaacttccgcgcagtgctcgataaccgtcaacgtcacgcctggctggagctggcaaaccagattgttgatgtcaaagcactcagtaaaaacgagctgcaaatcaccctgaaaagcgcctactatcctttcctgcaagaactggccctgccccgtcctttccgttttatcgcaccctcgcagtttaaaaaccacgaaaccatgaacggaattaaagcgccgattggcaccgggccgtgggttttacaggaatcgaaactgaatcagtacgatgtcttcgtccgtaacgaaaactactggggcgaaaagccagcgattaaaaagatcacctttaacgtgatcccggacccgactacccgcgcggtggcgtttgaaactggcgatatcgacctgctgtacggaaacgaagggttattaccgctcgataccttcgcccgctttagccagaacccggcttaccacacccaactgtcacagccgatcgaaaccgtgatgctggcgctcaataccgccaaagcccccaccaacgagctggccgtacgtgaagctcttaattacgcggtaaacaaaaaatcgctgattgataacgcgttgtatggcacccagcaggtcgccgacaccctgtttgctccttctgtaccctacgccaacctcggcctgaaaccgcgccagtacgatccgcagaaagcgaaagcgttgctggaaaaagccggttggacgttgcctgcgggcaaagacatccgcgagaaaaatggtcagccgctgcgcattgaactgtcgttcatcggcaccgatgcgttaagtaaatcgatggcggaaatcattcaggctgatatgcgccaggttggcgcagatgtctcgctgattggcgaagaagagagcagtatctatgctcgtcagcgcgacggtcgttttggcatgattttccaccgcacctggggcgcgccatacgatccacacgccttcctgagttcaatgcgcgtaccgtcgcacgctgatttccaggcacagcaaggattagccgacaagccgctgattgataaagagatcggcgaagtgctggcaacccatgacgaaacgcaacgtcaggcgctgtatcgcgacattctgacccgtctgcatgacgaggcggtttatctgcctatcagttacatctcaatgatggtggtatcaaaaccggagctgggtaacatcccctacgcgccgatcgccaccgaaattccgttcgaacagattaaaccggtgaaaccttaatgttgcgttacgtattacgccgctttctgctgctgatcccgatggtgctcgccgcctcggtgatcatttttttgatgctgcgcctcggcaccggcgacccggcgcttgattatttgcgtttatctaacctgccgccgacgccggagatgctgacctctacccgcaccatgctggggctggatcagccgctgtacgtgcaatacggcacctggctatggaaggcgctgcatcttgatttcggtatctcattcgccagccaacgcccggtgctggacgatatgctgaacttcctgcccgccacgctggaactggcgggtgcggcgctggtattaattctgctcacctccgtgccgctcggtatctgggctgcacgccaccgcgatcgcttgcccgatttcgccgtccgtttcatcgcgtttctcggcgtgtcgatgcccaacttctggctggcgtttttgctggtgatggcgttttcggtatatctgcaatggctacccgcgatgggctacggcggctggcagcacatcattttgcctgcggtttccattgcctttatgtcgctggcgattaacgcgcggctgctgcgcgccagtatgctggacgtcgccggtcagcgtcacgtcacctgggcgcggctacgcggcctgaatgacaaacagaccgagcgtcgtcatattctgcgcaatgcctcgctgccgatgatcaccgccgtggggatgcacattggcgaactgattggcgggacgatgattatcgaaaacatctttgcctggccgggcgtcgggcgctatgcggtgtcggcgatttttaaccgtgactatccggtgatccagtgctttacgctgatgatggtggtggtttttgtggtctgtaatttgattgtcgatttgctcaacgccgcgctggacccgcgcattcgtcgtcatgaaggagcccacgcgtgaactttttcctctcttcccgctggtcggtacgcctggcgctgatcattatcgccctgctggcgctgattgcgctcaccagccagtggtggctgccgtatgacccccaggcgattgatttgccgtcgcgcctgctttcgccggatgcgcagcactggttgggtaccgatcatttagggcgcgatattttctcgcggctgatggcggcgacccgcgtgtcgctcggctcggtaatggcctgcctgctgctggtgctgacattagggctagttattggcggcagcgccgggctgattggcgggcgcgttgatcaggccaccatgcgcgtcgcggatatgtttatgaccttcccgacttcgattctgtcgttctttatggtcggcgtactcggcaccgggttgaccaacgtgattatcgccatcgccctgtcgcactgggcgtggtatgcgcgcatggtgcgcagcctggtgatttcgctacgccagcgcgagtttgtgctggcgtcacggctttccggcgcgggccatgtgcgggtgtttgtcgatcatctggcaggcgcggtgatcccctcgctgctggtgctggcgacgctggatattggtcatatgatgctccacgtcgcggggatgtccttcctcggcctcggcgtgaccgcgcctaccgccgaatggggcgtgatgattaacgacgcgcgccagtatatctggacccagccgctgcaaatgttctggccggggctggcgctgtttatcagcgtgatggcctttaacctggtgggtgacgcactgcgcgatcatctggaccctcatctggtgacggagcacgcacactaatgccgcaacagattgaactacgtaatatcgcgctacaggccgcgcaaccgctggtgcacggcgtatcgttaactctgcaacgcgggcgcgtgctggcgttagtcggcagtagcggcagcgggaaatcattaacctgcgccgccgcactgggcattctgcccgcaggcgttcgccagacggcgggggaaattttagccgatggcaaaccggtttctccctgcgccctgcgcggcatcaaaattgccaccatcatgcagaacccgcgcagcgcctttaatccgcttcacaccatgcacacccacgcgcgggaaacctgcctggcgttagggaaacccgccgatgacgccacgcttaccgctgctttagaagcggtggggttggaaaacgccgcgcgcgtgttgaagctgtacccgttcgagatgagcggcggcatgttgcagcgcatgatgattgcgatggcggtgttgtgtgaatcgccgtttatcatcgccgatgaaccgaccaccgatctcgacgtggtagcacaggcgcgcatcctcgatctgctggaaagcattatgcaaaaacaagcgccgggaatgctgctggtgacccatgatatgggcgttgtggcgcgtctggcggatgacgtggcggtgatgtcacacggtaaaattgtcgaacagggcgatgtagaaacgctgtttaatgcccccaaacatgcggtaacgcgcagcctggtttccgctcatctcgccctctacggtatggagctggcatcatgactttacttaacgtctccgacctttcccatcactatgcgcacggtggatttagcggcaaacatcaacaccaggcggtgctgaataacgtttctttgactctgaaaagcggcgaaaccgtcgctctgctggggcgcagcggctgcggaaaaagcactctcgcgcggctgctggtaggcttagagtctccctcacaagggaatattagctggcgcggcgaaccgttggcaaagctcaatcgcgcccagcgtaaagcgttccgccgcgatattcagatggtatttcaggactccatcagcgccgtgaatccgcgcaaaaccgtgcgcgagatcctgcgcgagccgatgcgccacctgctatcgctaaaaaaatcggaacaactggcacgcgccagcgaaatgctgaaggcggtcgatctcgatgacagcgttctagacaaacgcccaccgcagttaagcggcggtcagctccagcgcgtctgcctggctcgcgcgctggcggtcgaaccgaaactactgattctggatgaagccgtttctaaccttgatctcgtgttacaggcgggcgtcattcgcctgctgaaaaagctacaacaacagtttggcactgcctgcctgttcatcactcatgacttacgcctggtggaacgcttttgccagcgagtgatggtgatggacaacgggcaaatcgtcgaaacccaggtggtgggagataaattaaccttttcctctgacgccggacgtgtgctacaaaacgcggtattacccgcataccccgtgcgccgtcgcgccacagaaaaggtttaagtctatgcaacgagttaccatcacgcttgatgacgatttactggagacgctggacagcctgagccagcgtcgtggctataacaaccgttccgaagctatccgcgatattctgcgtagcgccctggcgcaggaagctacccagcagcacggcacgcaaggtttcgcggtgctgtcgtatgtgtatgaacacgaaaaacgcgacttagccagccgtattgtctccacccagcaccatcaccacgatctctcagtcgccacgctgcatgtgcacattaatcacgacgactgtctggaaatcgccgtgttgaaaggtgacatgggcgacgtgcagcattttgccgatgacgtcatcgcccagcgcggcgtgcggcacgggcatttgcagtgcctgccgaaggaagattaacacctcccaacgcgccgttatttcctgacggcgcagtagacttctgccaaatatcgactcacgtcacatttttttgatcacgatttagtcccctaaaatgtgagacgcttcgatcctctttttcgcctgttcacctactatacgcttgaagttgtccatgattgtccatagacaactgtaaatgttcaggtgcgcgccatgaaatcattgagtaagtcgtcacaaataccgctctatcaacaagtggtggagtggataagagaaaatatttataccggggatctggtggaagacgatcgcattccttcggaataccagattatggatatgctggaagtgagtcggggaaccgttaaaaaagctgtcgcccaactggtaaaacaaggcgtgttgattcaggtccaggggaagggaacatttgtcaaaaaagagaacgtggcatatccgttaggtgaaggattattgtcattcgcggaatcgctggaaagccagaaaatacactttaccactgaagttattacgtcacggattgaaccggctaatcgttatgtggcagagaaattaagaataacgcccggtcaggatattctttaccttgagcgtttacgttcaattggtgatgaaaaagcgatgctgatagagaaccgtatcaatattgagctatgccccggcatcgtggaaatcgattttaatcaacacaatttatttccaacaatagaaagtttgtcgaaaagaaaaattcgttactcggaaagtcgctatgccgcgcgattaattggtaatgaacgcggtcattttttagatatctgtgaagatgtacccgttttgcatctggagcaattagtctttttctcccgagagttacccgttgagtttggcaacgtctggttaaaaggaaataaatattatctgggcaccgtgctgcaacggcgggaattgagttaaatacacttttttatgaggaataaaatgcaaggcatacagtttcaggaaaattatattcaacgacttccggcagggttaagcgttgaacagatcatccgtcagttagcgcaaccgttggttgctgctgagctggtggtccctgattttgccgatcacgtactgaaacgtgaggcgacgtacccaacggggctgcctaccgaaccaccgtgcgtcgccattccgcacacggaccataaatatgtcaggcacaatgcaattgccgtcggcatccttccggaaccggtagagtttgccgatatgggcggcgatcctgaccccgtacatgtcagggtgatttttttgctcgccttaagtgaaagtaataaacaattaaatgccctgggctggattatggagatgattcaggatacgccctttatgcgcgccctgcttacgatggaaacaacagaaatacacacagtaatcttaaacaaaatgaaagaacgaggtgaaatatgagtcaaaccattttatttgtctgcgccacgggtattgccacatccacggcggtaacagaaaaagtcatggaatattgtaaagagcacggtcttaacgtcaattattcccaaaccaacgttgcctctttacctggaaatactgacggcgtagcactggtagtctcaacgactaaagtgccttatgaactcgacgtcccggtggttaacggcttgccgattattaccggtattggcgaagagaaagtactggcgcaaattgtttcgatccttaaaaagtaattaataataattaatttcaacccactccatcaggcgctaacgcgaggtgcgctctcgcctgaaaaagaggtttattatgaacgatatcgcgcataccctctataatattgtgcaatatatattgggatttggtcccacggtaatgttgccgttggtgttatttattcttgctctcttttttaaagtaaaacccgctaaagccttacgttcgtcattaacggtcggcattggttttgtcggtatttatgccattttcgatattcttaccagcaatgtcgggccagcggcccaggcgatggttgaacgcaccggaattaatttaccggtggtggatttaggctggccgccgctttccgctattacatggggttcgccaattgccccgtttgttattcccctgactattctgattaacgtggcgatgctggcgttaaataaaacccgcaccgttgacgtagatatgtggaactactggcattttgcccttgccggtacgctggtttattacagcaccggcagcctgttctttggtttgctggcagcggcgattgctgcggtggtagtacttaaactcgccgactggtctgcgccactggtacaaaaatactttggcctggaagggatctctttgccgacgctctcttcggtggtgttctttccggtcggtctgttggtcgacaaaatcatcgaccatatccccggcctcaatcgtattcatatcgatccggaaaccgtacagaaaaagtttggcatattcggcgaaccgatgatggttggtactattctgggcattctgctcggcgtaattgccggatacgatttcaaaaaagtcttgctgcttggcatcagcattggcggtgtgatgttcatcctgccacgcatggttcgcattctgatggaaggtttattaccgctgtctgaagccattaaaaagtatctcaatgccaaataccctgaccgtgacgatctctatatcggcctggatatcgccgttgccgtaggtaacccagcgattatctccaccgccctgctgctgacgccaatctcggtctttatcgcgtttgtccttccgggtaatgaagtcctgccgcttggcgaccttgccaacctggcggtaatggcgtcgatgattgctttagccagccgtggcaacattttccgcaccgttctggcggcgattccggtgattattgccgatctgtggattgcgactaaaatcgcgccgtttattaccggaatggcgaaagacgttaatttcaaatttgccgaaggctccagcggccaggtctccagtttccttgatggcggtaacccgttccgcttctggctgctggaaatcttcaacggcaatctcatcgccattggtctggtgccggttatcgccctggtactgtatggtattttccgaatgacgcggagcacggtttatgcctgataacagcgcagctatcgttatcgatattggcaccaccaattgcaaagtcacctgcttttcctgcctggacgcaacgacgttgggcgcgcataaattcgtgacggcaaaacagatctccccacagggcaatgtcgatttcgatatcgacgccctctggcaggaggtccgccaggcgatagcgcaactgaacgccgcttcgccgctgccagtcaggcggataagcattgccagttttggcgagtcaggcgtgttccttgacgagcatggcgagatcctgacgccaatgctggcatggtatgaccgtcgcggtgaagagtatctggctacacttagcgaggcagacagtgcggcactttatgacatttgcgggttaccgctgcacagcaattactctgccttcaaaatgcgttggttgctggaacattacccactgcgtaatcgccgcggcctgcgttggctacatgcgccggaagtactgctctggcggctgaccggcgaacagcgcacggatatcaccttagccagccgcacgctgtgtcttgacgtgcgcaaaggcgaatggtcagcgaaagcggcggcgttgttacacgttccctgttcagcatttgcgccattggtgcagccaggcgaacacgccggatgggtcagcgagtcgctctgcaaaacggttgggttctcgcaaccggtcagcgtgacgctggccggacatgaccatatggtgggtgcgcgagcgttgcagatgatgccgggcgatatccttaactcgacggggaccacagaaggcattctgcaactggatacacaaccgacgctggatgaacaggccaaacgtgacaagctggcaaacggctgttattcgcttgcaaaccagttcaccctgtttgcgtcgctgcccgtgggcggtttcgctctggagtggctgcgtaacacgttccggctaaccgatgaggagatcgccgcatcacttactcgcggacatgcggattacctggcggggaactggtcgctcgatgacattcccctctttattccacatcttcgcggttcgggttcgccctataaaaatcgccatactcgtggattattttatgggcttggcgatacgttaaatatcgacatgttaattgccagcgtctcactgggattaaccatggaatttgccaactgcttcgcctgttttaatgtgcctggcaccagcgcgttaaaagtgataggtccggcaacccaaaatcccctttggctgcaattaaaagcggatattttacagcgtccggttgaagcaattgcatttaacgaggcggtttctgtcggagcattattaactgccgcaccggatattccaccgccgcaagttaccatagcccaacgtttgttaccgaatcgggcgagataccatcaattacagcgttatcagcacaaatggaaaagctggtatcagttgaaattacagcaagaaggcgtgatgccattacaccatcgggaggagcactatgttgagtaaaaccgtggaggtcagaaacagtactggcctgcatgcacgtccggcggcgtgtctggtgaaagccgccaaaaagtttagctgtaaagtgacgctgcattatgagggtaatgatattaatgccaccagcatgatgaatattatgcgcgccggaataaaaggcggcaaaacggtggaaatacgctgcgaaggcgatgatgaaaatgaggcaatacaaactctcaccaccttatttcgtgaccgcttcggtgaagctgaataattaactgatattaaaagatgaggttttcaaatgccattagttaatggacggatactgctcgaccgcattcaggaaaaacgggtattagcgggcgcgtttaataccaccaatctggagacgacaatttcaattttaaacgctattgagcgttcgggattgcctaacttcattcagattgcgcccaccaatgcacaactctcgggatacgattacatttatgaaatcgtgaaacgtcacgccgataaaatggatgttccggtcagtcttcatctggatcacgggaaaactcaggaggatgttaaacaggcggtgcgcgcgggctttacctcggtcatgattgacggtgccgcattctcttttgaagagaatatcgctttcacccaggaagctgtcgatttctgtaaatcctatggcgtaccggttgaagcggagctgggggcgattctcggcaaagaagatgatcacgtcagcgaagccgattgcaaaacggaaccggaaaaggtgaagacctttgtcgagcgcaccggttgcgacatgctggcagtttctattggcaacgtacatggtctggacgatataccgcggatcgatatccccctgctgaagcgcattgccgaagtctgcccggtgccgctggttattcacggcggctccggtatcgccccggagatattgcgcagctttgttaattatcgcgtcgctaaagtaaatatcgccagcgatctgcgcaaagcgtttatcaccgccgtcggcaaagcgtatgtgaataatcacaacgaggcgaatctggcacgagtgatggcatcagcaaaaaacgccgtcgaggaagatgtgtatagcaaaatcctgatgatgaatgaggggcatcggttggttaagtaaatcctcgccggatgcggcgtaaaacaactacaattcaataaattgtaccgatgcgtagaccctataagcttacgcatcgggcaactgtatttacgccattgtcccaatcgtcttcctgaatcgcagcagcgcgatagtgaaaaatgcgccgccaattgccatcagcgtcaggaactgcggccagacgatttcgaatccggcaccacggtagagaatggcctgcgcgaggctgacaaagtgtgtcgtcggcatggtcagcataatgtcctgcaccgtctgcggcatactttcgcgcggcgtggatccaccggaaagcatttgcagcggtagcagcaccagaatcaccagcagccccagttgcggcattgaacgcgctatcgtccccataaaaatgccgatcgacgtagtggcaaacagactgagcgccacgcccagcataaacagcgggatcgagccttcaatcggtacgcccagcacgcctttcaccatcagtaccagcgataatcccgacaccaccagcaccaccaaccccatcgaccagaccttcgccatcatgatctcaaacggcgttatcggcatcaccagtaagtgttccaccgtgccgtgttcgcgctcgcggatcagcgccgatccggtcagcacaatcgccagcatggtaatgttgttgatgatcgccatcaccccgccaaaccacgcgggatcgaggttcgggttaaagcgcatccgggtttccagcgataccaacggttcgctattatcacggtagcgcgcgacaaagctgttcacttcaccgttgataatattctggatataaccgttgccagtgaatgcctggctcatgcgcgtggcatcgacgttcacctgaatatctggctggcgtccggcgaggacatcacgctgaaaattaggcggaatatttatcgcaaaggtataacgcccggcgtccagtccggcatccatctcatcggcggtgatcatctccggtggcaaaaaccacgggcgatagaagctgttaacgatccggttcgacagctgcgattgatccatatcggcaatagagatcggcgcgaggttcaacgatcctggcgtaacggtcgctgacgaatacaccgataccgtaaacgagaagacaatcagcgtcagcatcgctttatcaccgagcagactgcgcaactctttgatacccagattaaaaatattacgtaaatggcgcatcatccctcctgttttttcagcagcaggatgcttaagcccatcaccagcggtatggctatcagcagcgggataaaaagttgccacaaatcagtcagatccagcgctttcgagaacgtcccgcgggcgatagtcagaaaatgactggtcgggtaaacctcgccgatccaacgtcctggaccttccagcgaagctaccggatcgatcatcccggaaaactgtgtcgccgggatcaacgtgataatcgccgtaccgaaaatggcggcaatctggcttttcataaaggtggagatcagcagccccattccggtggcaatgatgatatacagcagcgccgccagggtgagcgtcaggaaactgcctttatgcggtacgccaaacacaaacaccgacaggccgcagagcaggaaaaagttcagcatccccagcgcaatgtacggcagctgtttgccaagcaaaaattcgctacgggtggtgggagtcacgtaaaggttgataatcgaccccaactctttttcccgcaccacgctaagggcgcttagcattgacggaatcatcatcagcagaagcgggatcaccgccggaacaatcgctggcaggctttttacgtccgggttatagcgatagcgcgtctcaatgttcatcagcccgctttggctggagggtgtggattgtcggctcgccacatcctgtagccagctctggtgcatggcctgcacgtaaccttttaccgtttcggcacggctcggcatcgcaccgtcaatccagacaccgagttccacaggcgtaccacgcgcgatatcgcgcccgaaattgggagggatctcaatcgccaccgtgatatcgcccgcacgcatccgacgatcaagctcgtcataactggtgagcggcggctgttcgataaagtaacgggaaccggagagattgagcgtccacgcctggctactgacggtctggtcgcggtcgagcaccgcaaagcgcaggttttccacatccatactgatgccgtaacccattatcagcatcaggatcaccgttcccatcagcgccagcgtcgaacgtaccggatcgcgccgcagttccagcgcttcgcggcggctgtagctaaacagacggcgcaggctaaatccctgacgcggcgcgtgggtggcgtcgtgtaccacgggcggcgcttcggcttcgctgctctgccctgccgcttcctgcaaataggcgataaatgcctcttccagactggcggctccgcgtttctcaaccagttcctgcggtgtaccgctggcgagcacttttccggcgtgcatcagtgagatacggtcgcaacgttccgcttcgttcataaagtgggtggagatgaagatagtcactttgtcctggcgcgagagatcgaccatcaactgccagaacatatccctcgccaccggatcgacaccagaagtaggctcatcgaggattaacatctccgggcgatgaatcaccgccaccgccagcgaaagccgctggcgaatgccgagcggtaatgactccggcagaacatcttcaacgtcgttgagcttaaaccgctcgctcatttcagccactcgcgcgggaatttccgcttccgggatgtgaaacaaacgggcatgtaactccaggttttgccgcacggtgagttcgttatagagcgaaaacgcctgcgacatatagcccacccgacggcgagtatcgatatcttttggatcaaccggttgcccgaacagccacgcctcaccttcgctggcgggcagcaatccggtaagcattttcatggtggtggatttaccgcagccgttcgaaccaagaaaaccaaaaatctccccgcgtggaatgcggaaattgacgtgatcaacggcaacgaaggaaccaaaacgcatggtcagatcgcgcgcttcgatggcaatctctgcgttttcaggttgatatggtgggatcactaccgcctgatgcgcctggcgttgcgcttgcggtaacagatttataaatgcttcttccagcgtggcgctttgcgtttgctgccgcagctcttcggcgctgccggttgccagcacttctccggcattcatcgctaccagccagtcgaagcgttcggcctcttccatgtaggcggtggcgaccagcacgctcatattgctctgccgctggcgaatactgtcgatcagatcccagaactgggcgcgggagagcgggtcaacccccgttgttggctcatcaagaatcaacaattccgggtcgtggattaacgcacagcacagccccagtttttgcttcatcccgccggagagtttacctgcaggacgatcgcgaaacggtgctaacccggtgctggtcagcagctcattaattcgcacttcccgctccgctttgtcgtgaccgaacaggcgggcgaaaaaatcgacgttttcatacaccgacaaggtgtggtagaggtttttgcccagcccctgcggcatccaggcgatgcgcgggcaaacgtcgcgtcgatgcttcgggtcgcgcatatcgccgcccagcaccatcacattgccctgctcaatgacgcgggcaccggaaatcaacgacaacaagctcgacttcccgacgccgtccgggccaatcagcccgaccatgcagcgggccggaatatcgagagtgatattgttcagcgcaacggtttttccataatgctggctcacgcctgccagttgcgcgacaggcgggacgggaaccagttccagatgcgtcattgcggcaacctcaccaccaggtcgtcaggccacggaagttcttcattcacccgcacccacgctatgcccggcaaaccggttttgacatattccagatgctgctggagtaattccggtgggatacgcgctttgacgcggaacattagtttcagccgttcatcgctggtttcgacagtttttggcgtgaactgggcgacgctggcgacaaaactgatggtcgccggaatacgcagatctggcgcggcatcgaggatcagccgggcttcaccgcccagtttcagcgtgcccgcctgttcggttggcaggaagaaggtcatatagacgtcgctgagatcgaccatattcagcacccgaccgcctgccgccagcacttcgcctggctcggcaacccgatactgcacgcgtccgtcacgcggggctttcagttcgctgtcatcgatatctgcggcaatacgccgttcagtggcttgcgcggcttcgacgcgagtttgcgcctgaatgatattggtgcgtgccgcttctatagcggctttagaagccgaaacctgggcttttgctgattccagcgcagctcgggcgctctcagcggcggcgcggtcgtcatccagctgttgcgcagaaatagcccctcgttgggcgagcgagcgggaacgcgtatgacgtttggcaacggagtccagttcggcctggcgttgattgaccagcgactgtgcggcacgagtttcgctttgccgttgctccagcaaagcctgcgcggcggcaatggcgctttgtgcctctttgatttgcgcgatggcttccagtcgctgttcctgcaacacgcgagtatccatcttcgccagcacttcgccttcgcgaacaaactggccttctttcaccagaatggtgtcgatacgcccggcaattttactggcgatatccacttccgtcgcttcaatgcgcccattactgacggcaaaaccttccggcacacctgccgggcgcaacagccaccacgccacgatagcggccaccgccagtaacccgacaacccaccacgccagatggcgcttactcttatccataatcgacccgccataatccctgtaatcaaacgacgcgtgttacaactgccgccgaacgacgttcagcggattcttccatccgggataagaaggaaacggcaaatacgaccagcgcgcagagcattgagcgccaacgtggaaggcttagtgaaaacgggtagtaatgttgtcatcatcagcattcctggccgtaaatgaaacacgcatactcataagtgtgatctataaaactggctgacaaaacggtatccatcctgttggatagcgtttcacgcctgttcagttgcaggaacagagcattccttattacgttttatcaacagtctcaaccagatagtaacattaatattcatgttgtctatggttcagagctgtaacattgtgcgccttctaatcaaaggcataagtccatttttgtttttttcatgctggtaagacttccagggagtggttatctcaggccctgcaccagggttaatttggcaattatgcatgctgaacattcttccagcatgtttactgtcacgggcgttaagacctaaaactgtccccgtttcacctatgcgttctctcccaccatttccgttatgtgcaacaacttgatttatacctaacatttgtgagcatgctaatagtgcttcaagtttaggcctgtaatctgtcgaaacagaaaaataacgattaaaggatcgacaagagatagcccggctagttttaaactttttaccattaatgatggcatgatgcttcttattaataattgccgctaattcgaccggatcgagagcattggtcatttcatcaatagagactgttatcggtcctataatgtaacgttttcgctgatcatcaaaagttatcccatgatgatttgccattattttgtatttggggtcatagaaacatacaggataatcttttatcccagcgtaggtatcctcatcaagtggtttcatacgcgtgaagttctgcatatagttaccattgcaattcgtttcatgattaccagctaatacatgaacatttttattaatactcattatgcgttttaacaaatcgatgataaattgatcgccacagatattactaaatcgatcgccggtttggtcacccagaaacgtacatggcgtcactgcgccctgattaataactaaatatggctgaaaactttctaaaaccacatctcttctgttcagaatactgattattgtattaacattaatgtctagttcctcattaattttttcccttaataaaacgttgagaacttcatcttctatattaagcaactggctaagaaaatttactccttcagccataattcccaaatgtcccgttgcgaaaagcgcgtacaaaactgcaccgactgagccatcggtatcaccaaaataggttggtctggtacttgtgggatcaacgggtgaacaattggagaaatagattctgtcagcgaactggggttttataattgtttcgaatttaatatcagatacattatattgcgatattttccagttccagatgggtttgtacgactcagtaactgcaacatcattagcattatcatttactgtcatattattaagtaaataaacaatgctgtaccaattaatatcggtatcatcaagagggcaaccgtaatttttactattaattgtcacaataaactgataactattattcctacgtagaatatgggcacgcatgcccgatagcatactatatttttctgaatgattcgtttctatggtaaatgaaattttgtcatcttgaaaagattgttggaaacgttctatttgccaatcatcaattttttccacaacttcaccgagcattgtcctggcaatacttgatatatcatcacctataccatttgcaatatacccaaacagttctttagtgaagttagtaacatgctcttgcaccatatcatttgttgcgatagtcgttatactgtcgttagtacctgccacagttctaagtttcatcttttacctcatataattcaccgcaaggaatacatagttatcatttaatcttatgacatacacctcatgttcgacgggaaaataattatattttgcacaaatcattcagccttaaagcataatatgaaatttcttatctcatagtagagaaagtccctaaagattgtagaggcgtcatcagtatatgcctctacaatcgattaagaaaaactatgaaatactggcaggattaaaaagatataccaccgtattcatagagttttaatgagattgaaaacaactaagccctgggacaccttttttatcaccacgttcgttaggtgctatcttccaggaatttagccccatggtataattatcaattttttgatgctgatctacccctaatccataatggccatatttctgtttactttttttgagcgtctgtccacatttgaagatatcttcaggttttggtctgaaagcagtagtgttattaaaataattgtcatatacaggtgtggatgctatagcattgcttctaattagatggataagacgatcatccatgtgttgtttatgttttttattaaatatatttgctaattcctcaggatcaattgggtctttcatctgattaaatggaacctgcaaagcacctagacaataacattcattttcttcatttcttattattccgtgatgactggttaaaactttcgtttctgagtcataattacaaacatcgagcgttttaattaagtcatatgtatcaccggaagagagtttatgatttgctagtcgtgcactatagttaccattaaaattgatttcatgatttccagccagaacgacaacatttttatttatacgactatctttattaccctccatatttcgcatagaatttagcaaagtaaggatatatttatcaccaaaaatagtactaaatctatcgcctgtatgatccccaaggaagatacaaggggtaatcgcatcgccttttaaaaaaacatgttgatgcaactcattcaagatcatgtctctcgtatctaataaagtgaagagttttttcaattttttattttcatatgcgaatgacgccatgtcttcgtgttttaataattgacataataaactccacccctctcccctgatgcctatatgccctgaaacgagcaatgcataaagtacagcgcccactcttccatctgtatcgccaaaataagccgtgttgggattttttgggttaatcacaccacactgtttataaaagtctatttttgaaaaaacagattcaacatagctatcaaacttttccttagtaaacgtctctttagagacagcccaacgccagtcagctttaaaattaccgctaagaagagtaaaaaaattttcaggtatgatagaaaacccatcaactttataaattatgtctgatttatccccggagaaattaataaaataataaccgtccttacgctcaatcgtaacggtaatgggagacgataattttatcacatggttattgtctggtataattgtaaagataaacgtgtcagtagtattatcggcgaaactattatattctttaatatctatagatggctcactattgtaaaaccacagtttttctatctgaggactatgttcagttacgttccagcagccatgttgcaggaaatagatgatatgcaggccaaaatcgttatctatttgcgaatgtttatccagcttatcaatttcaactatctttgaacgatgttttttatcaacattgccatggtgttgatgactgttaactttatctgaatgcttatcttgatggtttgaagagaagtgcttaaatatattgtgaaatactttcataaataacccgtgatatttttgacttgttagtaacaaaataaataacacatgtctgaaagacatttttacgatgatacaaagcaataatacttatatgttcgatgattttaagcaccgataccatccggtcttttaccaaataatgaaaaagaatccctccctggaagataattgtaaaaaacaacagaataagaattaatcttaggataaatatttatttaccatggccttttgaacgctgaaaagtagcgctctgcaaagtaaatcccgctatagttatgctatgcatttgtctttaatgatatctcgtcattgtattaacaggctgaaattatcattaatgcacatttcaatattagcagggatacctgaggagtttaaagtgaacatatatatcgggtggcttttcaaattaatccctttaattatgggcttaatttgtatcgcgttaggtggctttgtgctggaaagttctgggcaaagtgagtatttcgtcgcgggtcatgtgctgatttccctggcagccatatgcctggcattattcactaccgcatttattatcatttcgcagctcacgcgcggcgttaatacgttttacaatacattgttccccattattggctatgcggggtcaattatcaccatgatatggggttgggcactgttagcaggcaatgatgtgatggcagacgagtttgttgccggccatgttatttttggcgttggtatgattgccgcctgtgtatcgacagtggcagcgtcatccggtcactttctgctcattcccaaaaacgcagcagggagcaagagcgatggaacaccggtacaggcttattcttcattaatcggtaattgcctcattgccgttcccgttttactcaccctgctcggtttcatttggtctattacgctgttacgtagtgccgacataactccgcattatgtcgccggtcacgtattgcttgggttaaccgcaatctgtgcctgtctaattggccttgttgccacaattgtccatcaaacacgtaatacgttctcatccaaagaacactggctgtggtgttattgggttattattctcggctcaatcacggtgctgcagggcatatacgtgttagtcagctccgatgcaagcgcccgactggctcccggcattatcctcatttgcctcggaatgatctgttacagcatattctcaaaagtctggctactggcactggtctggagacgtacctgttcgttagccaacagaataccgatgattcccgtcttcacctgcctgttttgccttttcctggcatcgtttcttgcagaaatggcgcagaccgacatagggtattttattccttcgcgggttctggtcggtttgggagcggtatgctttacgttgttctcaatcgtttcaatattagaagcaggttctgctaaaaaataattgcaacgtaccggataaaaccagcgttgaccatttgcgtaacgctggtttttctcaggtatcatgaaataacgcagaattaatgcatagtggttaagtataaaaaaacagcaaagttgctgattttttcaacctgttcatattttataaagatctggccactgggggagttttaatcacctttccttccaccttatattaagcatggagggtttcagttcacaggctcattagaaaataatcacaagataaccactatcaaaattagctcatttttaatgcgactctaataattttcatctttaggaaatagctcaggacgacttcgctgcaatcaaatcctgcgcacaagcccatgcactcgaccacgcccactggaagttatagccccccagccagccggtgacgtccatcacttcgccgatgaagtacagcccaggcactttgcgcgcttccatcgtccgtgaagagagttcgttggtgtccacgccgccgagcgtcactt
